(12) United States Patent
Punt

(10) Patent No.: US 11,066,681 B2
(45) Date of Patent: Jul. 20, 2021

(54) PRODUCTION OF ITACONIC ACID

(71) Applicant: LESAFFRE ET COMPAGNIE, Paris (FR)

(72) Inventor: Peter Jan Punt, Utrecht (NL)

(73) Assignee: LESAFFRE ET COMPAGNIE, Paris (FR)

(*) Notice: Subject to any disclaimer, the term of this patent is extended or adjusted under 35 U.S.C. 154(b) by 36 days.

(21) Appl. No.: 16/327,413

(22) PCT Filed: Aug. 25, 2017

(86) PCT No.: PCT/EP2017/071466
§ 371 (c)(1),
(2) Date: Feb. 22, 2019

(87) PCT Pub. No.: WO2018/037123
PCT Pub. Date: Mar. 1, 2018

(65) Prior Publication Data
US 2019/0177751 A1   Jun. 13, 2019

(30) Foreign Application Priority Data
Aug. 26, 2016 (EP) .................................... 16185980

(51) Int. Cl.
| | | |
|---|---|---|
| *C12P 7/44* | (2006.01) | |
| *C12N 15/52* | (2006.01) | |
| *C12N 9/10* | (2006.01) | |
| *C12N 9/22* | (2006.01) | |
| *C12N 15/11* | (2006.01) | |
| *C12N 15/113* | (2010.01) | |
| *C12N 9/88* | (2006.01) | |

(52) U.S. Cl.
CPC .............. *C12P 7/44* (2013.01); *C12N 9/1007* (2013.01); *C12N 9/13* (2013.01); *C12N 9/22* (2013.01); *C12N 9/88* (2013.01); *C12N 15/11* (2013.01); *C12N 15/1137* (2013.01); *C12N 15/52* (2013.01); *C12Y 208/03* (2013.01); *C12Y 401/03025* (2013.01); *C12Y 402/01056* (2013.01); *C12N 2310/11* (2013.01); *C12N 2310/14* (2013.01); *C12N 2310/20* (2017.05)

(58) Field of Classification Search
None
See application file for complete search history.

(56) References Cited

U.S. PATENT DOCUMENTS 8,143,036 B2 * 3/2012 Liao .......................... C12P 7/46
  435/145
9,879,270 B2 * 1/2018 Hittinger ................ C12Q 1/045

FOREIGN PATENT DOCUMENTS

WO    2015181312 A2    12/2015

OTHER PUBLICATIONS

Huang et al. (Improving itaconic acid production through genetic engineering of an industrial Aspergillus terreus strain, Microbial Cell Factories, 2014, 13:119).*
International Search Report and Written Opinion in corresponding International Patent Application No. PCT/EP2017/071466 dated Dec. 1, 2017. 10 pages.
Chen et al. "Identification of an itaconic acid degrading pathway in itaconic acid producing Aspergillus terreus." Applied Microbiology and Biotechnology 100.17 (2016): 7541-7548.
Sasikaran et al. "Bacterial itaconate degradation promotes pathogenicity." Nature Chemical Biology 10.5 (2014): 371-379.
Yamamoto et al. "Challenges in the production of itaconic acid by metabolically engineered *Escherichia coli*." Bioengineered 6.5 (2015): 303-306.

* cited by examiner

*Primary Examiner* — Suzanne M Noakes
*Assistant Examiner* — Jae W Lee
(74) *Attorney, Agent, or Firm* — Leason Ellis LLP

(57) ABSTRACT

The invention relates to a method to increase production of itaconic acid in a micro-organism by inhibiting the expression or functioning of the enzyme itaconyl-CoA transferase, itaconyl-CoA hydratase (citramalyl-CoA hydrolyase; EC 4.2.1.56) and/or citramalyl-CoA lyase. Also embodied are micro-organisms, preferably *Aspergillus terreus* or *Aspergillus niger*, in which said enzyme is inhibited.

Figure 1:
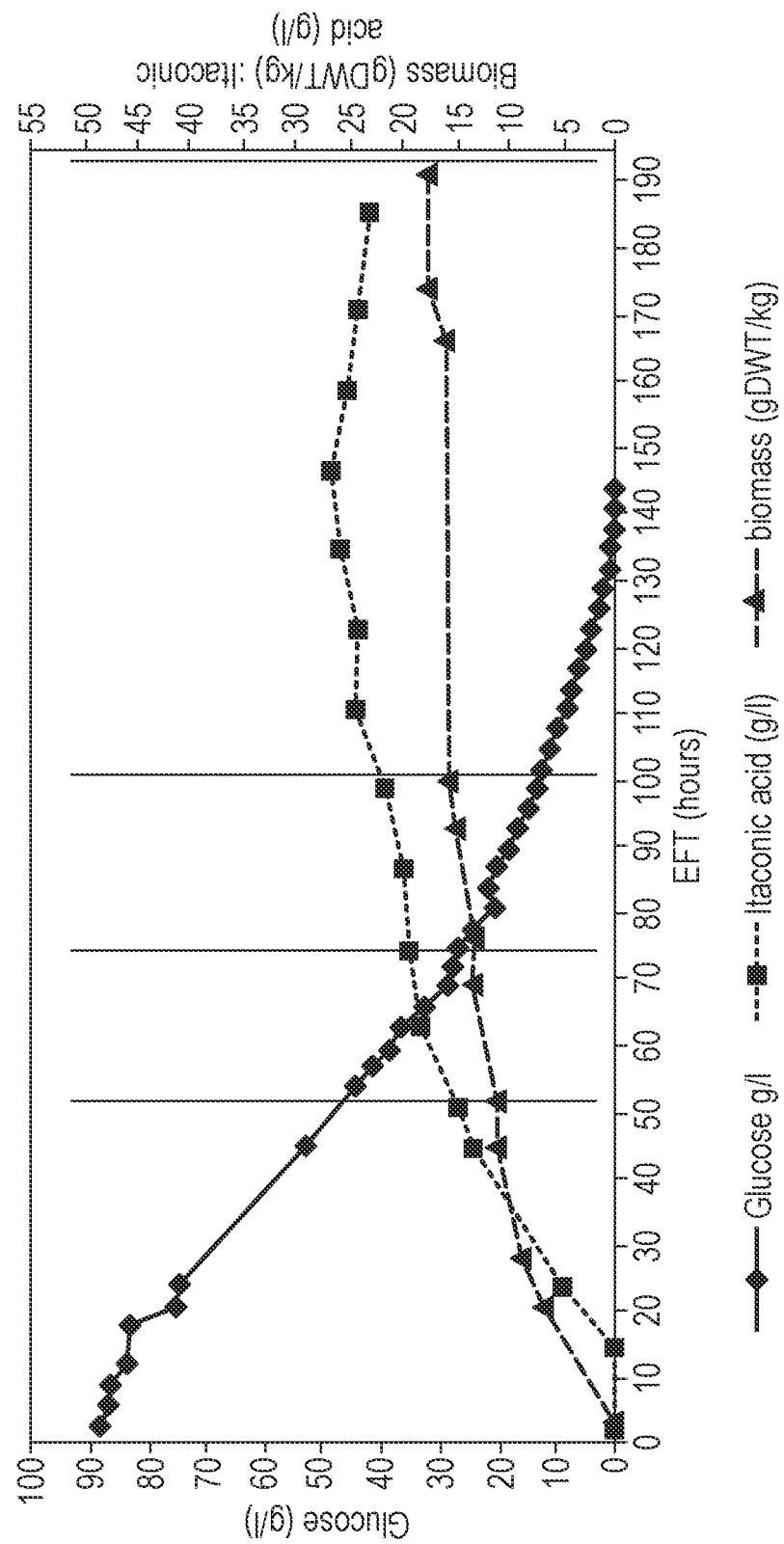

15 Claims, 59 Drawing Sheets
Specification includes a Sequence Listing.

Fig. 11

Blast results for itaconyl-CoA transferase
    An07g00760, ATEG_06299
    An18g05120, ATEG_02992, ATEG_03794, ATEG_09143
    An11g10300, ATEG_01554

Alignments itaconyl-CoA transferase EC 2.8.3.-
XP_001391168.1  CAIB/BAIF family enzyme [Aspergillus niger CBS 513.88](SEQ ID NO:45)
EHA23704.1 hypothetical protein ASPNIDRAFT_40237 [Aspergillus niger ATCC 1015](SEQ ID NO:46)
GAA92309.1 CAIB/BAIF family enzyme [Aspergillus kawachii IFO 4308](SEQ ID NO:47)
GAQ39945.1 CAIB/BAIF family enzyme [Aspergillus niger](SEQ ID NO:48)
XP_001215477.1  hypothetical protein ATEG_06299 [Aspergillus terreus NIH2624](SEQ ID NO:49)
AND01113.1 itaconyl-CoA transferase [Aspergillus terreus](SEQ ID NO:50)
XP_015411786.1  CAIB/BAIF family enzyme [Aspergillus nomius NRRL 13137](SEQ ID NO:51)
KJK61899.1 CoA-transferase family III [Aspergillus parasiticus SU-1](SEQ ID NO:52)
XP_001817553.1  CAIB/BAIF family enzyme [Aspergillus oryzae RIB40](SEQ ID NO:53)
XP_002372659.1  CAIB/BAIF family enzyme [Aspergillus flavus NRRL3357](SEQ ID NO:54)
KJJ31924.1 alpha methylacyl-CoA racemase [Aspergillus flavus AF70](SEQ ID NO:55)
EYE92894.1 CAIB/BAIF family enzyme [Aspergillus ruber CBS 135680](SEQ ID NO:56)
GAO86382.1 uncharacterized protein YfdE [Aspergillus udagawae](SEQ ID NO:57)
XP_748858.1  CAIB/BAIF family enzyme [Aspergillus fumigatus Af293](SEQ ID NO:58)
XP_001261603.1  alpha methylacyl-CoA racemase [Aspergillus fischeri NRRL 181](SEQ ID NO:59)
CEL03321.1 Putative Alpha-methylacyl-CoA racemase [Aspergillus calidoustus](SEQ ID NO:60)
CBF90284.1 TPA: CAIB/BAIF family enzyme (AFU_ortholog; AFUA_7G06520) [Aspergillus nidulans FGSC A4](SEQ ID NO:61)
XP_657662.1  hypothetical protein AN0058.2 [Aspergillus nidulans FGSC A4](SEQ ID NO:62)
CEL09785.1 hypothetical protein ASPCAL12914 [Aspergillus calidoustus](SEQ ID NO: 63)
XP_001818947.1  CAIB/BAIF family enzyme [Aspergillus oryzae RIB40](SEQ ID NO: 64)
KJK63717.1 CoA-transferase family III [Aspergillus parasiticus SU-1](SEQ ID NO: 65)
GAA89989.1 CAIB/BAIF family enzyme [Aspergillus kawachii IFO 4308](SEQ ID NO: 66)
CBF74899.1 TPA: conserved hypothetical protein [Aspergillus nidulans FGSC A4](SEQ ID NO: 67)
KMK57138.1 CAIB/BAIF family enzyme [Aspergillus fumigatus Z5](SEQ ID NO: 68)
XP_001398966.1  CAIB/BAIF family enzyme [Aspergillus niger CBS 513.88](SEQ ID NO: 69)
XP_001265042.1  CAIB/BAIF family enzyme [Aspergillus fischeri NRRL 181](SEQ ID NO: 70)
XP_001269532.1  CAIB/BAIF family enzyme [Aspergillus clavatus NRRL 1](SEQ ID NO: 71)
CEN60056.1 Putative CoA-transferase family III [Aspergillus calidoustus](SEQ ID NO: 72)
EYE99383.1 CoA-transferase family III [Aspergillus ruber CBS 135680](SEQ ID NO: 73)
XP_750374.1  CAIB/BAIF family enzyme [Aspergillus fumigatus Af293](SEQ ID NO: 74)
KEY81259.1 hypothetical protein CAIB/BAIF [Aspergillus fumigatus var. RP-2014](SEQ ID NO: 75)
CEL09034.1 Putative Succinyl-CoA:3-ketoacid-coenzyme A transferase 1, mitochondrial [Aspergillus calidoustus](SEQ ID NO: 76)
KKK20152.1 hypothetical protein AOCH_002002 [Aspergillus ochraceoroseus](SEQ ID NO: 77)
XP_015405578.1  hypothetical protein ANOM_006123 [Aspergillus nomius NRRL 13137](SEQ ID NO: 78)
GAQ44411.1 PHD finger domain protein [Aspergillus niger](SEQ ID NO: 79)
KKK17524.1 hypothetical protein ARAM_002522 [Aspergillus rambellii](SEQ ID NO: 80)
XP_001273489.1  hypothetical protein ACLA_008230 [Aspergillus clavatus NRRL 1](SEQ ID NO: 81)
XP_661834.1  hypothetical protein AN4230.2 [Aspergillus nidulans FGSC A4](SEQ ID NO: 82)
XP_001212170.1  hypothetical protein ATEG_02992 [Aspergillus terreus NIH2624](SEQ ID NO: 83)

Fig. 11 (Cont. I)

```
XP_001391168  1  ------------------------------MPNTRPLVR-AACHNLSGM--R----H----A---STSAT----------KKAG  30
EHA23704      1  -----------------------------------------M--R----H----A---STSAT----------KKAG  13
GAA92309      1  ------------------------------MPTTRPIVR-AACHSLSSI-R----H----A---STNTA----------KKAG  30
GAQ39945      1  ------------------------------MPTTRPIVR-AACHNISSI-R----H----A---STNTA----------KKAG  30
XP_001215477  1  ------------------------------MSLSRPLAR-AWAQTLAPSTRR----H----T---STQAG----------K-TG  31
AND01113      1  ------------------------------MSLSRPLAR-AWAQMLAPSTRR----H----T---STQAG----------K-TG  31
XP_015411786  1  ------------------------------MAPMRPLSQ-ALGLRLPGA-R----N----V---STQAS----------PK-G  29
KJK61899      1  ------------------------------MAPLRPLSQ-ALYSRIPGA-R----G----V---STQAS----------PK-G  29
XP_001817553  1  ------------------------------MAPWRPLSQ-ALYSRIPGA-R----S----V---STQTS----------PK-G  29
XP_002372659  1  ------------------------------MAPWRPLSQ-ALYSRIPGA-R----S----V---STQTS----------PK-G  29
KJJ31924      1  ------------------------------MAPWRPLSQ-ALYSRIPGA-R----S----I---STQTS----------PK-G  29
EYE92894      1  ------------------------------M-LRRPTWQ-LC--RRWGT-R----A----L---STKTT----------D--G  25
GAO86382      1  ------------------------------MAIVRPSVR-ALPRQFLII-HR----N----S---STNTPATQNNTRRQKKKG  40
XP_748858     1  ------------------------------MALVRPSVR-ALPRQLLII-HR----N----S---STSTSAIQDNIKQQQKKG  40
XP_001261603  1  ------------------------------MALVRPSVR-ALPRQLLII-HR----N----S---STSTSVTQNNVKRQQKKG  40
CEL03321      1  ------------------------------MFGRLSRTQ-CIPLPTISGSIR----HFSLSA---ARRN-----------QG  33
CBF90284      1  ------------------------------MFARASCPR-CLSQPAISRSVR----RFSCAA---ARRNS----------DNQG  36
XP_657662        ----------------------------------------------------------------------------------
CEL09785      1  ------------------------------MNPLLRTIVCPSARVVRAN---STI---P----SKTT----------KTG  30
XP_001818947  1  --MSVTLKLEQAFRA-RRPALRWS--SSVL-R----T----------TAQWR-TYSS--T-P---ADDTL-----------  43
KJK63717      1  --MSVTLKLEQAVIA-RRPALRWS--SSVL-R----T----------TAQWR-TYSS--T-P---ADDTL-----------  43
GAA89989      1  MNLTAALRVQRACVA-RR------S--IYLP-R---R----------TTQWR-SYSS--A-V---SDDTL-----------  40
CBF74899      1  ------------------------------MLLSRAPLR-LLKPIGVSI--R-SLATHAK----SKNKKL-----------  32
KMK57138      1  --MNGAWALQRAMAR-RP------S--LYSL-R----T----I-LKCKPQGR-RFSA--IPT----SDETL-----------  43
XP_001398966  1  MNPTAALRVQRACIA-RR------S--IYVP-R---R----------TTQWR-SYSS--A-V---SDDTL-----------  40
XP_001265042  1  --MNAACMLQRAVAR-RP------S--LYSS-R----T----IILKCTPQGR-RFSA--IPT----SDDTL-----------  44
XP_001269532  1  --MNATLKLHWAVAR-RP------S--LYLS-K----T----IP-RCTPQRR-RFSA--IPA----SEDTL-----------  43
CEN60056      1  --MNVTFKLQRALIA-QRPNVRQLTKSNIIIR----Q---------ATQWR-SYSTPLA-G----ADGTL-----------  48
EYE99383      1  --MSVALKFQALVRRSVVNSPIVAAAAGL--Q----R----------TAPWRRSYSS--A-I---GD-TL-----------  45
XP_750374     1  ---------------MAR-RP------S--LYSL-R----T----I-LKCKPQGR-RFSA--IPT----SDETL---------  33
KEY81259      1  ---------------MAR-RP------S--LYSL-R----T----I-LKCKPQGR-RFSA--IPT----SDETL---------  33
```

Fig. 11 (Cont. II)

```
CEL09034          1    ------------------------MIL--AALRPLLKPNGLSISFR-TLATTTTPPKPKQNKKL------------------  37
KKK20152          1    ---MNVALKLQRAFIA-QRPWLRQPGRNNIV-R----Y----------ATQWR-SYSTPVA-P----ADGTL----------------  47
XP_015405578      1    ---MSVTLKLHQTVLA-RRSALRWS--SSVL-RR---S----------AAPWR-TYSS--T-P----ADDTL----------------  44
GAQ44411          1    MNLTAALRVQRACVA-RRSIY----------L-PR--R----------TTQWR-SYSS--A-V---SDDTL----------------  40
KKK17524          1    ---MNVALKLQRAFIA-QRPLLRQPGRNNIV-R----Y----------ATQWR-SYSTPVA-P----ADGTL----------------  47
XP_001273489      1    --------------------------MALSRRLVW--ALSRHWSTICR-IYSTTRTNPNLNNSDNNST----------KKG  42
XP_661834         1    ---MNATFRLQRVLIA-QRPSIQRSTRTNIF-R----H----------ATQWR-SYSSSPLP-P----ADGTL----------------  47
XP_001212170      1    MNVTLKLRRSVFAPALRR------S---GGLL-RAQLR----------TPQWR-PYST--A-P----ADDTL----------------  44

XP_001391168     31    PLAGITVVSLEQAIAAPFCTRQLADLGARVIKVERPGVGDFARNY----------DTRVN----GLASHFVWTNRSKESLALD  99
EHA23704         14    PLAGITVVSLEQAIAAPFCTRQLADLGARVIKVERPGVGDFARNY----------DTRVN----GLASHFVWTNRSKESLALD  82
GAA92309         31    PLAGITVVSLEQAIAAPFCTRQLADLGARVIKVERPGVGDFARNY----------DTRVN----GLASHFVWTDRSKESLALD  99
GAQ39945         31    PLAGITVVSLEQAIAAPFCTRQLADLGARVIKVERPGVGDFARNY----------DTRVN----GLASHFVWTNRSKESLALD  99
XP_001215477     32    PLTGITVVSLEQAIAAPFCTRQLADLGARVIKVERPGVGDFARNY----------DTRVN----GLASHFVWTNRSKESLALD 100
AND01113         32    PLTGITVVSLEQAIAAPFCTRQLADLGARVIKVERPGVGDFARNY----------DTRVN----GLASHFVWTNRSKESLALD 100
XP_015411786     30    PLSGITVVSLEQAIAAPFCTRQLADLGARVIKIERPGVGDFARNY----------DTRVN----GLASHFVWTNRSKESLALD  98
KJK61899         30    PLSGITVVSLEQAIAAPFCTRQLADLGARVIKIERPGVGDFARNY----------DTRVN----GLASHFVWTNRSKESLALD  98
XP_001817553     30    PLSGITVVSLEQAIAAPFCTRQLADLGARVIKIERPGVGDFARNY----------DTRVN----GLASHFVWTNRSKESLALD  98
XP_002372659     30    PLSGITVVSLEQAIAAPFCTRQLADLGARVIKIERPGVGDFARNY----------DTRVN----GLASHFVWTNRSKESLALD  98
KJJ31924         30    PLSGITVVSLEQAIAAPFCTRQLADLGARVIKIERPGVGDFARNY----------DTRVN----GLASHFVWTNRSKESLALD  98
EYE92894         26    PLTGITVVSLEQAISAPPCTRQLADLGARVIKIERPGVGDFARHY----------DTRVN----GLASHFVWTNRSKESLALD  94
GAO86382         41    PLSGITVVSLEQAIAAPFCTRQLADLGARVIKIERPKVGDFARNY----------DTRVN----GLSSHFVWTNRSKESLALD 109
XP_748858        41    PLSGITVVSLEQAIAAPFCTRQLADLGARVIKIERPKVGDFARNY----------DSRVN----GLSSHFVWTNRSKESLALD 109
XP_001261603     41    PLSGITVVSLEQAIAAPFCTRQLADLGARVIKIERPEVGDFARNY----------DTRVN----GLSSHFVWTNRSKESLALD 109
CEL03321         34    PLSDITVVSLEQAIAAPFCTRQLADLGARVIKVERPGVGDFARNY----------DTRVN----GLASHFVWTNRSKESLALD 102
CBF90284         37    PLAGITVVSLEQAIAAPFCTRQLADMGARVIKIERPGVGDFARGY----------DTRVN----GLASHFVWTNRSKESLALD 105
XP_657662         1    --------------------MGARVIKIERPGVGDFARGY----------DTRVN----GLASHFVWTNRSKESLALD  44
CEL09785         31    PLAGIKILDLTRVLAGPFCTQILADYGADVIKVENPKGGDTRLWRESGEDAIWKPDEAGTKTSLYFNTINRNKRSIALD 110
XP_001818947     44    PLKGVRVLDMTRVLAGPYCTQILGDLGADVIKIEHPVRGDDTRAWGPPYAKYQDESRQ-GPGESAYYLGVNRNKKSLGLS 122
KJK63717         44    PLKGVRVLDMTRVLAGPYCTQILGDLGADVIKIEHPVRGDDTRAWGPPYAKYQDESRQ-GPGESAYYLGVNRNKKSLGLS 122
GAA89989         41    PLKGIRVLDMTRVLAGPYCTQILGDLGADVIKIEHPVRGDDTRAWGPPYATYTDGS-E-GPGESAYYLGVNRNKKSIGLS 118
CBF74899         33    PLAGLKVLDLSRVLAGPYCTQILGDLGADIIKIEHPVRGDDTRAWGPPYAPYIDGR-E-GPGESAYYLSVNRNKRSLALS 110
KMK57138         44    PLKGIRVLDMTRVLAGPYCTQILGDLGADIIKVEHPVRGDDTRAWGPPYAKYIDGSHD-GPGESAYFLAVNRNKRSIGLS 122
XP_001398966     41    PLKGIRVLDMTRVLAGPYCTQILGDLGADVIKIEHPVRGDDTRAWGPPYATYTDGS-E-GPGESAYYLGVNRNKKSIGLS 118
XP_001265042     45    PLKGIRVLDMTRVLAGPYCTQILGDLGADIIKVEHPVRGDDTRAWGPPYAKYIDGSHD-GPGESAYFLAVNRNKRSIGLS 123
XP_001269532     44    PLKGIRVLDMTRVLAGPYCTQILGDLGADIIKVEHPVRGDDTRAWGPPYAKYTDESRK-GPGESAYYLAVNRNKRSIGLS 122
CEN60056         49    PLQGIRVLDMTRVLAGPYCTQILGDLGADVIKVEHPTRGDDTRAWGPPHAKYTDNS-K-GPGESAYYLAVNRNKKSVGLS 126
EYE99383         46    PLTGIKVLDMTRVLAGPYCTQILGDLGAEVIKVEHPVRGDDTRAWGPPFAKYQDESRQ-GPGESAYYLAVNRNKKSIGLS 124
XP_750374        34    PLKGIRVLDMTRVLAGPYCTQILGDLGADIIKVEHPVRGDDTRAWGPPYAKYIDGSHD-GPGESAYFLAVNRNKRSIGLS 112
KEY81259         34    PLKGIRVLDMTRVLAGPYCTQILGDLGADIIKVEHPVRGDDTRAWGPPYAKYIDGSHD-GPGESAYFLAVNRNKRSIGLS 112
CEL09034         38    PLAGLKVLDLSRVLAGPYCTQILGDLGADIIKIEHPVRGDDTRAWGPPYAPYLDGR-E-GQGESAYYLSVNRNKRSLALS 115
KKK20152         48    PLQGVRVLDMTRVLAGPYCTQILGDLGADVIKIEHPVRGDDTRAWGPPYAKYKDGS-Q-GPGESAYYLGVNRNKKSLGLS 125
XP_015405578     45    PLKGVRVLDMTRVLAGPYCTQILGDLGADVIKIEHPVRGDDTRAWGPPYAKYQDESRQ-GPGESAYYLGVNRNKKSLGLS 123
GAQ44411         41    PLKGIRVLDMTRVLAGPYCTQILGDLGADVIKIEHPVRGDDTRAWGPPYATYTDGS-E-GPGESAYYLGVNRNKKSIGLS 118
KKK17524         48    PLQGVRVLDMTRVLAGPYCTQILGDLGADVIKIEHPVRGDDTRAWGPPYAKYKDGS-Q-GPGESAYYLGVNRNKKSLGLS 125
XP_001273489     43    PLSGVTVVGLEQAIAAPFCTRQLADLGARVIKIERPG---------------------------------------  79
XP_661834        48    PLQGIRVLDMTRVLAG------ILGDLGAEVIKVEHPVRGDDTRAWGPPYAKYANDS-KEGPGESAYYLAVNRNKKSIGLS 121
XP_001212170     45    PLKGVRVLDMTRVLAGV----------SYVIKVEHPVRGDDTRAWGPFYATYQDESRQ-GPGESAYYLAVNRNKKSIGLS 113
```

Fig. 11 (Cont. III)

```
XP_001391168   100  LKKPSDHSVLMRLLGRADVLVQNLAPGASARLGLSYDDLKAAHPSLIVCNISGYGPDGPYRDKKAYDLLIQSEAGMLSVT   179
EHA23704        83  LKKPSDHSVLMRLLGRADVLVQNLAPGASARLGLSYDDLKAAHPSLIVCNISGYGPDGPYRDKKAYDLLIQSEAGMLSVT   162
GAA92309       100  LKKPSDHSVLMRLLSRADVLVQNLAPGASARLGLSYADLKAAHPSLIVCNISGYGPDGPYRDKKAYDLLIQSEAGMLSVT   179
GAQ39945       100  LKKPSDHSVLMRLLGRADVLVQNLAPGASARLGLSYADLKAAHPSLIVCNISGYGPDGPYRDKKAYDLLIQSEAGMLSVT   179
XP_001215477   101  VKKPRDHQVLMRLLSKADVLVQNLAPGASARLGLSHEDLKATNPSLIVCNISGYGPDGPYRDKKAYDLLIQSEAGMLSVT   180
AND01113       101  VKKPRDHQVLMRLLSKADVLVQNLAPGASARLGLSHEDLKATNPSLIVCNISGYGPDGPYRDKKAYDLLIQSEAGMLSVT   180
XP_015411786    99  LKKPRDHGVLMRLLGKADVLVQNLAPGASARLGLSHEELKIKHPSLIVCNISGYGPDGPYRDKKAYDLLIQSEAGMLSVT   178
KJK61899        99  LKKPRDHGVLMRLLGKADVLVQNLAPGASARLGLSHEELKAKHPSLIVCNISGYGPDGPYRDKKAYDLLIQSEAGMLSVT   178
XP_001817553    99  LKKPRDHGVLMRLLGKADVLVQNLAPGASARLGLSHEELKAKHPSLIVCNISGYGPDGPYRDKKAYDLLIQSEAGMLSVT   178
XP_002372659    99  LKKPRDHGVLMRLLGKADVLVQNLAPGASARLGLSHEELKAKHPSLIVCNISGYGPDGPYRDKKAYDLLIQSEAGMLSVT   178
KJJ31924        99  LKKPRDHGVLMRLLGKADVLVQNLAPGASARLGLSHEELKAKHPSLIVCNISGYGPDGPYRDKKAYDLLIQSEAGMLSVT   178
EYE92894        95  VKNPRDHRVLMRLLGRADVLVQNLAPGASGRLGLSYEVLKANHPSLIVCNISGYGPDGPYRDKKAYDLLIQSEAGMLSVT   174
GAO86382       110  VKNPSDYHILMRLLSCADVLVQNLAPGASARLGLSFADLSEKHPSLIVCNISGYGPDGPYRDKKAYDLLIQSEAGLLSVT   189
XP_748858      110  VKNARDHRILMRLLSRTDVLVQNLAPGASARLGLSFADLSEKHPSLIVCNISGYGPDGPYRDKKAYDLLIQSEAGLLSVT   189
XP_001261603   110  VKNARDHRILMRLLSRADVLVQNLAPGASARLGLSFADLSEKHPSLIVCNISGYGPDGPYRDKKAYDLLIQSEAGLLSVT   189
CEL03321       103  VKKPSDHAVLMKLLGKADVLVQNLAPGASSRLGLSFDDLKESHPGLIVCDISGYGQDGPYRDKKAYDLLVQSEAGMLSVT   182
CBF90284       106  VKNPEDHEVLMRLVSKADVLVQNLAPGASARLGLSFETLKEEHPSLIVCDISGYGQDGPYRDKKAYDLLVQSEAGMLSVT   185
XP_657662       45  VKNPEDHEVLMRLVSKADVLVQNLAPGASARLGLSFETLKEEHPSLIVCDISGYGQDGPYRDKKAYDLLVQSEAGMLSVT   124
CEL09785       111  LKSEAGKKVVLQLARGADVVVENFIPGKLDKLGLGYETLKAVNPQLILASISGYGASGPYAHRAGYDVIGAAEGGLLHIT   190
XP_001818947   123  FQHKSGVEILHRLAKECDVLVENYLPGSLKKYNMDYETLREINPKLIYASITGYGQTGPYSNRAGYDVMVEAEMGLMHIT   202
KJK63717       123  FQHKSGVEILHRLAKECDVLVENYLPGSLKKYNMDYETLREINPKLIYASITGYGQTGPYSNRAGYDVMVEAEMGLMHIT   202
GAA89989       119  FAHKSGVEILHRLAKECDVLVENYLPGSLKKYNMDYETLRSINPRLIYASITGYGQTGPYSNRAGYDVMVEAEMGLMHIT   198
CBF74899       111  FAHPQGQNILHRLVREADILVENYIPNSLAKYKLDYPTLSTINPSLIYTSITGYGQTGPYSNRPGFDVMVEAEFGLAHLT   190
KMK57138       123  FAHKSGVEILHKLAKECDVLVENYLPGTLKKYGLDYETLRSINPRLIYASITGYGQTGPYSNRAGYDVMVEAEMGLMHIT   202
XP_001398966   119  FAHKSGVEILHRLAKECDVLVENYLPGNLKKYNMDYETLRSINPKLIYASITGYGQTGPYSNRAGYDVMVEAEMGLMHIT   198
XP_001265042   124  FAHKSGVEILHKLAKECDVLVENYLPGTLKKYGLDYETLRSINPRLVYASITGYGQTGPYSNRAGYDVMVEAEMGLMHIT   203
XP_001269532   123  FAHKSGIEILHKLAKECDVLVENYIPGSLKKYGLDYETLRSINPKLIYASITGYGQTGPYSNRAGYDVMVEAEFGLMHIT   202
CEN60056       127  FQHKSGVEILHKLVKECDVLVENYLPGSLKKYNMDYETLREINPSLIYASITGYGQTGPYSNRAGYDVMVEAEFGLMHIT   206
EYE99383       125  FAHKPGVEILHKLVKECDVLVENYLPGGLKKYNMDYETLHAINPKLIYASITGYGQTGPYSNRAGYDVMVEAEMGLMHIT   204
XP_750374      113  FAHKSGVEILHKLAKECDVLVENYLPGTLKKYGLDYETLRSINPRLIYASITGYGQTGPYSNRAGYDVMVEAEMGLMHIT   192
KEY81259       113  FAHKSGVEILHKLAKECDVLVENYLPGTLKKYGLDYETLRSINPRLIYASITGYGQTGPYSNRAGYDVMVEAEMGLMHIT   192
CEL09034       116  FADPRGQRILQKLATQSDILVENYLPGSLKKYSLDYTTLSSLNPRLIYTSITGYGQTGPYANRPGFDVMVEAEFGLAHLT   195
KKK20152       126  FAHKAGVDILHRLVKECDVLVENYLPGSLEKYNMDYETLREINPKLIYASITGYGQTGPYSNRAGYDVMVEAEMGLMHIT   205
XP_015405578   124  FQHKSGVEILHRLAKECDVLVENYLPGSLKKYNMDYETLREINPKLIYASITGYGQTGPYSNRAGYDVMVEAEMGLMHIT   203
GAQ44411       119  FAHKSGVEILHRLAKECDVLVENYLPGSLKKYNMDYETLRSINPKLIYASITGYGQTGPYSNRAGYDVMVEAEMGLMHIT   198
KKK17524       126  FAHKAGVDILHRLVKECDVLVENYLPGSLEKYNMDYETLREINPKLIYASITGYGQTGPYSNRAGYDVMVEAEMGLMHIT   205
XP_001273489        --------------------------------------------------------------------------------
XP_661834      122  FAHKSGVDILHKLVKECDVLVENYLPGSLKKYNMDYETLREINPSLIYASITGYGQTGPYSNRAGYDVMVEAEMGLMHIT   201
XP_001212170   114  FAHKSGVEILHRLAAQCDVLVENYLPGSLKKYNMDYETLREINPKLIYASITGYGQTGPYSNRAGYDVMVEAEMGLMHIT   193
```

Fig. 11 (Cont. IV)

```
XP_001391168  180  GTG-KEPAKVGISIADISAGSYAYSNILAALYQRERDPS-------KRGCNIDISMLESMVEWMGFPMYYTYENAPGPT--  250
EHA23704      163  GTG-KEPAKVGISIADISAGSYAYSNILAALYQRERDPS-------KRGCNIDISMLESMVEWMGFPMYYTYENAPGPT--  233
GAA92309      180  GTG-KEPAKVGISIADISAASYAYSNILAALYQRERDPA-------KQGCNIDISMLESMVEWMGFPMYYSYENAPGPT--  250
GAQ39945      180  GTG-KEPAKVGISIADISAGSYAYSNILAALYQRERDPA-------KRGCNIDISMLESMVEWMGFPMYYTYENAPGPT--  250
XP_001215477  181  GTG-KEPAKVGISIADISAGCYAYSNILAALIQRDKDPK-------RRGCNIDISMLESMVEWMGFPMYYTYANAPGPT--  251
AND01113      181  GTG-KEPAKVGISIADISAGCYAYSNILAALIQRDKDPK-------RRGCNIDISMLESMVEWMGFPMYYTYANAPGPT--  251
XP_015411786  179  GTA-QEPAKVGISIADISAGSYAYSNILAAIIQRGNDPE-------KRGCNIDISMLESMVEWMSFPLYYTYQNAPRPT--  249
KJK61899      179  GTA-QEPAKVGISIADISAGSYAYSNILAAIIQRGNDPE-------KRGCNIDISMLESMVEWMSFPLYYTYQNAPRPT--  249
XP_001817553  179  GTA-QEPAKVGISIADISAGSYAYSNILAAIIQRGNDPE-------KRGCNIDISMLESMVEWMSFPLYYTYQNAPRPT--  249
XP_002372659  179  GTA-QEPAKVGISIADISAGSYAYSNILAAIIQRGNDPE-------KRGCNIDISMLESMVEWMSFPLYYTYQNAPRPT--  249
KJJ31924      179  GTA-QEPAKVGISIADISAGSYAYSNILAAIIQRGNDPE-------KRGCNIDISMLESMVEWMSFPLYYTYQNAPRPT--  249
EYE92894      175  GTGAKQPAKVGISIADIAAGSYAYSNILAALFRRERDPK-------KCGCNLNISMLESMVEWMGFPLYYTYEGAPGPT--  246
GAO86382      190  GTG-TEPAKVGISIADICAGSYAYSNILAALFERERDPE-------RRGRNIDISMLESMVEWMGFPMYYTYGDQPGPT--  260
XP_748858     190  GTA-TEPAKVGISIADICAGSYAYSNILAALFERERDPE-------RRGRNIDISMLESMVEWMGFPMYYTYGDQPGPT--  260
XP_001261603  190  GTA-TEPAKVGISIADICAGSYAYSNILAALFERERDPE-------RRGRNIDISMLESMVEWMGFPMYYTYGDQPGPT--  260
CEL03321      183  GTG-NEPAKVGISIADIASGMYAYSNILAALLQRSK---T-------GRGSHIDISMLESMVEWMGFPMYYAYNGAPGPV--  251
CBF90284      186  GTG-KEPAKVGISIADIASGMYAYSNILAALMQRSK---T-------GRGSHIDISMLESMVEWMGFPMYYAPNGAPGPV--  254
XP_657662     125  GTG-KEPAKVGISIADIASGMYAYSNILAALMQRSK---T-------GRGSHIDISMLESMVEWMGFPMYYAPNGAPGPV--  193
CEL09785      191  GEPDGRPTKPGVGLMDMCTGLYLHGAIVSALLARERT---------GEGQKLDTSLFETTISILS-NVGMSWLNLGREAK-  260
XP_001818947  203  GARGGDPVKVGVAVTDLTTGLYTSNAIMAALLARVRT---------GMGQHIDACLSDCQVATLA-NIASSALISGEKDTG  273
KJK63717      203  GARGGDPVKVGVAVTDLTTGLYTSNAIMAALLARVRT---------GKGQHIDACLSDCQVATLA-NIASSALISGEKDTG  273
GAA89989      199  GSREGEPVKVGVAVTDLTTGLYTSNAIMAALLARART---------GKGQHIDACLSDCQVATLA-NIASSALISGKKDSG  269
CBF74899      191  GSKNGPPVKVGVAVTDLTTGLYAVQSILAALWQRAQSKENGEAGKGEGQHLDVCLSDCQVATLA-NMGQGPLISGQKDSG  269
KMK57138      203  GSRDGDPVKVGVAVTDLTTGLYTSNAIMAALLARMRT---------GQGQHIDACLSDCQVATLA-NIASSALISGEKDSG  273
XP_001398966  199  GSREGEPVKVGVAVTDLTTGLYTSNAIMAALLARART---------GKGQHIDACLSDCQVATLA-NIASSALISGKKDSG  269
XP_001265042  204  GSRDGDPVKVGVAVTDLTTGLYTSNAIMAALLARMRT---------GQGQHIDACLSDCQVATLA-NIASSALISGEKDSG  274
XP_001269532  203  GSRDGDPVKVGVAVTDLTTGLYTSNAIMAALLARVRT---------GQGQHIDACLSDCQVATLA-NIASSALISGKKDSG  273
CEN60056      207  GSRNGDPVKVGVAVTDLTTGLYTSNAIMAALLARVRT---------GKGQHIDACLSDCQVATLA-NIASSALISGKKDSG  277
EYE99383      205  GARDGAPVKVGVAVTDLTTGLYTSNAIMAALIARGRT---------GKGQHIDASLSDCQVATLS-NLASSALISGKKDSG  275
XP_750374     193  GSRDGDPVKVGVAVTDLTTGLYTSNAIMAALLARMRT---------GQGQHIDACLSDCQVATLA-NIASSALISGEKDSG  263
KEY81259      193  GSRDGDPVKVGVAVTDLTTGLYTSNAIMAALLARMRT---------GQGQHIDACLSDCQVATLA-NIASSALISGEKDSG  263
CEL09034      196  GSRDGPPVKVGVAVTDLTTGLYAVNSILAAVVARATT---------NEGQHLDVCLSDCQVATLA-NMGSSVLISGDKDSG  266
KKK20152      206  GSRDGDPVKVGVAVTDLTTGLYTSNAIMAALLARVRS---------GKGQHIDACLSDCQVATLA-NIASSALISGEKDSG  276
XP_015405578  204  GARDGDPVKVGVAVTDLTTGLYTSNAIMAALLARMRT---------GKGQHIDACLSDCQVATLA-NIASSALISGEKDTG  274
GAQ44411      199  GSREGEPVKVGVAVTDLTTGLYTSNAIMAALLARART---------GKGQHIDACLSDCQVATLA-NIASSALISGKKDSG  269
KKK17524      206  GSRDGDPVKVGVAVTDLTTGLYTSNAIMAALLARVRS---------GKGQHIDACLSDCQVATLA-NIASSALISGEKDSG  276
XP_001273489   80  ----------------VGDICAESYAYSSILAALFEREKDPA-------RRGWSIDISMLECMVEWMGFLLYYAPEGQGGPK--  138
XP_661834     202  GSRGGDPVKVGVAVTDLTTGLYTSNAIMAALLARVRT---------GKGQHIDACLSDCQVATLS-NIASSALISGQKDSG  272
XP_001212170  194  GSRDGPPVKVGVAVTDLTTGLYTSNAIMAALLARART---------GKGQHIDACLSDVQVATLA-NIASSALISGEKDSG  264
```

Fig. 11 (Cont. V)

```
XP_001391168   251   PAGASH------------AAIYPYGPFETGDG-TVMLGIQNEREWAKFCDIVLGQPSLATNERFVNNSLRSQNRDELKKII   318
EHA23704       234   PAGASH------------AAIYPYGPFETGDG-TVMLGIQNEREWAKFCDIVLGQPSLATNERFVNNSLRSQNRDELKKII   301
GAA92309       251   PAGASH------------AAIYPYGPFETGDG-TVMLGIQNEREWAKFCDIVLGQADLATDERFVNNSLRSQNRDELKKII   318
GAQ39945       251   PAGASH------------AAIYPYGPFETGNG-TVMLGIQNEREWAKFCDIVLGQADLATDERFVNNSLRSQNRDELKKII   318
XP_001215477   252   PTGASH------------AAIYPYGPFETGDG-SVMLGIQNEREWTNFCDKVLGKPELATDSRFANNSLRSQNREELKIII   319
AND01113       252   PTGASH------------AAIYPYGPFETGDG-SVMLGIQNEREWTNFCDKVLGKPELTTDSRFVNNSLRSQNREELKIII   319
XP_015411786   250   PTGATH------------AAVYPYGPFETGDKSVMLGIQNEREWVNFCEKVLSLPDLAADERFVNNSLRSQNRDALKEII   318
KJK61899       250   PTGASH------------AAVYPYGPFETGDKSVMLGIQNEREWVNFCEKVLSLPHLATDERFVNNSLRSQNRDALKDII   318
XP_001817553   250   PTGASH------------AAVYPYGPFETGDKSVMLGIQNEREWVNFCEKVLSLPDLMTDERFVNNSLRSQNRDALKEII   318
XP_002372659   250   PTGASH------------AAVYPYGPFETGDKSVMLGIQNEREWVNFCEKVLSLPDLMTDERFVNNSLRSQNRDALKEII   318
KJJ31924       250   PTGASH------------AAVYPYGPFETGDKSVMLGIQNEREWVNFCEKVLSLPDLMTDERFVNNSLRSQNRDALKEII   318
EYE92894       247   PAGAAH------------AAIYPYGPFETGDKSVMLGIQNEREWASFCDKVLGQPGLAKDGRFVSNSLRVQNRDALKIII   315
GAO86382       261   PAGASH------------AAIYPYGPFETGKG-TVMLGIQNEREWARFCEIVLERPEMAMDERFCNNSLRVKNRAVLRETI   328
XP_748858      261   PAGAAH------------AAIYPYGPFETGKG-TVMLGIQNEREWAKFCEMVLEKPEMTTDERFCNNSLRVKNRDALRETI   328
XP_001261603   261   PAGASH------------AAIYPYGLFETGKG-TVMLGIQNEREWAKFCEMVLEKPEMTTDERFCNNSLRVKNRDALRETI   328
CEL03321       252   PAGASH------------ASIYPYGPFETGDGQSVMLGIQNEREWANFCTLVLSQPDLATDARFSTNSVRTQNREALKDII   320
CBF90284       255   PAGASH------------ASIYPYGPFETGNG-SVMLGIQNEREWAKFCTLVLSQPDLITDARFSNNSLRVQNRDALKEII   322
XP_657662      194   PAGASH------------ASIYPYGPFETGNG-SVMLGIQNEREWAKFCTLVLSQPDLITDARFSNNSLRVQNRDALKEII   261
CEL09785       261   RWGTGH------------PTIVPYEAFRTADSWFVMGAVNDRQFGV-LCG-LLGVEELVSDERFRGNDERVRNRGVLREIL   327
XP_001818947   274   RWGTAH------------PSIVPYRSYQTLDGDILFGGGNDRLFGV-LCD-RLGHPEWKTDPRFVTNSDRVKNRGEIDGLI   340
KJK63717       274   RWGTAH------------PSIVPYRSYQTLDGDILFGGGNDRLFGV-LCD-RLGHPEWKTDPRFVTNSDRVKHRREIDGLI   340
GAA89989       270   RWGTAH------------PSIVPYRSYKTLDGDILFGGGNDRLFGV-LCD-RLGHPEWKTDPRFVTNSDRVKHRTDIDGLI   336
CBF74899       270   RWGTAH------------PSVVPYQSFATADGDIFVGGANDKLFGI-LCA-RLNKPEWACDARFVTNSDRVANRSVLEEMI   336
KMK57138       274   RWGTAH------------PSIVPYRSYQTLDGDILFGGGNDRLFGV-LCD-RLGFPEWKTDPRFITNRDRVKHREELDDLI   340
XP_001398966   270   RWGTAH------------PSIVPYRSYKTLDGDILFGGGNDRLFGV-LCD-RLGHPEWKTDPRFVTNSDRVKHRTDIDGLI   336
XP_001265042   275   RWGTAH------------PSIVPYRSYQTLDGDILFGGGNDRLFGV-LCD-RLGFPEWKTDPRFITNRDRVKHREELDGLI   341
XP_001269532   274   RWGTEH------------PSIVPYRSYKTIDGDILLGGGNDRLFGI-ICD-RLGYPEWKADPRFVTNSDRVKHRKELDGMI   340
CEN60056       278   RWGTEH------------PSIVPYRSYSTLDGDILFGGGNDRLFGV-LCD-RLGHPDWKEDPRFLTNSDRVKHRAEIDGLI   344
EYE99383       276   RWGTAH------------PSIVPYRSYKTRDGDILFGGGNDKLFGV-LCD-RLGYPEWKTDVRFVTNSDRVKHREEVDGLI   342
XP_750374      264   RWGTAHRKLMDMVLPALASIVPYRSYQTLDGDILFGGGNDRLFGV-LCD-RLGFPEWKTDPRFITNRDRVKHREELDDLI   341
KEY81259       264   RWGTAHRKLMDMVLPALASIVPYRSYQTLDGDILFGGGNDRLFGV-LCD-RLGFPEWKTDPRFITNRDRVKHREELDDLI   341
CEL09034       267   RWGTAH------------PSVVPYQSFPTANGDIFVGGANDRLFGI-LCE-RLGKKEWASDARFKSNSDRVANRTVLEALI   333
KKK20152       277   RWGTEH------------PSIVPYRSYQTVDGDILFGGGNDRLFGV-LCD-RLGHPEWKSDPRFLTNRDRVQHRAEIDGLI   343
XP_015405578   275   RWGTAH------------PSIVPYRSYQTLDGDILFGGGNDRLFGV-LCD-RLGHPEWKTDPRFVTNSDRVKHRGEIDGLI   341
GAQ44411       270   RWGTAH------------PSIVPYRSYKTLDGDILFGGGNDRLFGV-LCD-RLGHPEWKTDPRFVTNSDRVKHRTDIDGLI   336
KKK17524       277   RWGTEH------------PSIVPYRSYQTVDGDILFGGGNDRLFGV-LCD-RLGHPEWKSDPRFLTNRDRVQHRAEIDGLI   343
XP_001273489   139   PAGASH------------AAIYPCGPFEAKQG-IVMLGIQNEQEWANFCKIVLEESGLTIDECFCNNTLRPKIRVALKEII   206
XP_661834      273   RWGTEH------------PSIVPYRSYQTLDGDILFGGGNDRLFGV-LCD-RLGHPEWKEDPRFLTNRDRVKHRAVIDGLI   339
XP_001212170   265   RWGTEH------------PSIVPYRSYKTRDGNILFGGGNDRLFGV-LCD-RLGHPEWKEDPRFITNQDRVKHREDIDGMI   331

XP_001391168   319   CDVFSSLSAEQVIARLDAAAIANASVNDMQGVWNHPQLKARQRWTDVKTPAG---------SVPALLP----PGMTMGD---   384
EHA23704       302   CDVFSSLSAEQVIARLDAAAIANASVNDMQGVWNHPQLKARQRWTDVKTPAG---------SVPALLP----PGMTMGD----  367
GAA92309       319   CDVFSSLSAEQVIARLDEAAIANASVNDMQGVWNHPQLKARQRWTDVETPAG---------TVPALLP----PGMTLGD---   384
GAQ39945       319   CDVFSTLSAEQVIARLDEAAIANASVNDMQGVWNHPQLKARQRWTNVETPAG---------TVPALLP----PGMTMGD---   384
XP_001215477   320   CEVFSSLTADQVIARLDGASIANASVNDMQGVWKHPQLKARGRWTEIETPAG---------TVPALFP----PG---MDA---   383
AND01113       320   CEVFSSLTAEQVIARLDGASIANASVNDMQGVWKHPQLKARGRWTEIETPAG---------TVPALFP----PG---MDG---   383
XP_015411786   319   CEAFSSLTAEKVVTLLDEAAIANGNVNDMQGVWEHPQLKARGRWTEVSTPAG---------TVPALLP----PGLTQGD----  384
```

Fig. 11 (Cont. VI)

```
KJK61899        319  CEAFSSLTAERVVTLLDEAAIANGNVNDMQGVWEHPQLKARGRWTEVSTPAG---------TVPALLP----PGLTQGD----  384
XP_001817553    319  CEAFSSLTAEKVVTLLDEAAIANGKVNDMQGVWEHPQLKARGRWTEVSTPAG---------TVPALLP----PGLTQGD----  384
XP_002372659    319  CEAFSSLTAEKVVTLLDEAAIANGKVNDMQGVWEHPQLKARGRWTEVSTPAG---------TVPALLP----PGLTQGD----  384
KJJ31924        319  CEAFSSLTAEKVVTLLDEAAIANGKVNDMQGVWEHPQLKARGRWTEVSTPAG---------TVPALLP----PGLTQGD----  384
EYE92894        316  CDVFALRTAEDVLALLDKASIANASVNDMQGVWNHPQLQARQRWTEVQTPSS---------VVPTLLP----PGMG-AD----  380
GAO86382        329  CNVFASYSAEGILQRLDEAGIANASVNDMQGVWNHPQLRARQRWTQIQTSAG---------TVPALFP----PGM---G----  391
XP_748858       329  CKVFAAYSAEGVLRRLDEAGIANAIVNDMQGVWNHPQLRARQRWTQIQTPAG---------AVPALFP----PGT---G----  391
XP_001261603    329  CKVFAAYSAEGVLRRLDEAGIANAIVNDMQGVWNHPQLRARQRWTQIQTSAG---------AVPALFP----PGM---G----  391
CEL03321        321  HKSFADLTAGEATRRLDEASIANANVNDMHGVWEHAQLRSRNRWTEVQTPEG---------PVPALLP----PGFA---PLSS  387
CBF90284        323  HKSFANITAEEATRRLDEAAIANANVSDMQGVWEHTQLRARNRWTEVKTPGG---------TVPALLP----PGFS--P----  386
XP_657662       262  HKSFANITAEEATRRLDEAAIANAN-------------LRARNRWTEVKTPGG---------TVPALLP----PGFS--P----  313
CEL09785        328  EGVMVTRTTGDWETVPEGSGMPYGPINNLEQVFGHPQALARGMVETVASGAAVSGEVKVLGIPVKFSGTKPSIREGP----  404
XP_001818947    341  EEKVKQKTTQEWLEILEGSGMPYAAVNDIQGTLNHSHVQARGMVTEVDHPAC--GPIKLVNTPIKYSHATPGVRTPP----  415
KJK63717        341  EEKVKQKTTQEWLEILEGSGMPYAAVNDIQGTLNHSHVQARGMVTEVDHPAC--GPIKLVNTPIKYSHATPGVRTPP----  415
GAA89989        337  EETVKQKTTQEWLEILEGSGMPYAAVNDIQGTLNHSHVQARGMVTEVDHPAC--GPIKLVNTPIKYSHATPGIRTPP----  411
CBF74899        337  EHETRKLSTKEWQERFQGSGLPFAVVNDVLGTMGHEHVQARGMVQTIAHPAC--GLIKVISPPVKYSNAEPSIRRAP----  411
KMK57138        341  EKRVKQKTTQEWLEILEGSGMPYAAINDIQGTLNHSHVQARGMVTEVDHPAC--GPVKLVNTPIKYSHATPGVRRPP----  415
XP_001398966    337  EETVKQKTTQEWLEILEGSGMPYAAVNDIQGTLNHSHVQARGMVAEIDHPAC--GPIKLVNTPIKYSHATPGIRTPP----  411
XP_001265042    342  EKRVKQKTTQEWLEILEGSGMPYAAINDIQGTLNHSHVQARGMVTEVDHPAC--GPVKLVNTPIKYSHATPGVRRPP----  416
XP_001269532    341  EKTIAQKTTQEWLDILEGSGMPYAAINDIQGTLNHSHVQARGMVTEVDHPAC--GPIKLVNTPIKYSHATPGVRRPP----  415
CEN60056        345  EDRVREKTTQHWLEIMEGSGMPYAAVNDIQGTLNHEHVKARGMIVDVDHPAC--GPMKLVNTPIKYSHATPGVRTPP----  419
EYE99383        343  ETTTKQKTTKEWLEIFEGSGMPYAAVNDIQGTLNHSHVQARGMVTEVDHPDC--GPVKLVNTPIKYSHATPGIRTAP----  417
XP_750374       342  EKRVKQKTTQEWLEILEGSGMPYAAINDIQGTLNHSHVQARGMVTEVDHPAC--GPVKLVNTPIKYSHATPGVRRPP----  416
KEY81259        342  EKRVKQKTTQEWLEILEGSGMPYAAINDIQGTLNHSHVQARGMVTEVDHPAC--GPVKLVNTPIKYSHATPGVRRPP----  416
CEL09034        334  EAETRRLDTAEWQQRFEGSGLPFAVVNDVKGTMEHEHVQARGMVQTIAHPAC--GPIKVISPPVKYSNAEPSVRRPP----  408
KKK20152        344  EECVKQKTTQEWLDILEGSGMPYAAVNDIQGTLNHAHVQARGMITEIEHPSC--GPIKLVNTPIKYSHATPGVRTPP----  418
XP_015405578    342  EEKVKQKTTQEWLEILEGSGMPYAAVNDIQGTLNHSHVQARGMVTEVDHPAC--GPIKLVNTPIKYSHATPGVRTPP----  416
GAQ44411        337  EETVKQKTTQEWLEILEGSGMPYAAVNDIQGTLNHSHVQARGMVAEIDHPAC--GPIKLVNTPIKYSHATPGIRTPP----  411
KKK17524        344  EECVKQKTTQEWLDILEGSGMPYAAVNDIQGTLNHAHVQARGMITEIEHPSC--GPIKLVNTPIKYSHATPGVRTPP----  418
XP_001273489    207  CGKLAQYSAEEVLKKPGYGWNC----------------------------------------------------------  228
XP_661834       340  EDCVKQKTTQQWLEIMEGSGMPYAAVNDIQGTLNHEHVRARGMVTEIDHPAC--GPVKLVNTPIKYSHATPGVRTPP----  414
XP_001212170    332  EETAMQKTTQEWLEIMEGSGMPYAAVNDIQGTLNHAHVRARGMVTEIDHPAC--GPIKLVNTPIKYSHATPGVRTPP----  406
```

Fig. 11 (Cont. VII)

```
XP_001391168    385    -EDTYGARMDAVPDVGEHNKAILAEL----GL-----DEGTEK---------------------------------------    417
EHA23704        368    -EDTYGARMDAVPDVGEHNKAILAEL---GL-----DEGTEK---------------------------------------    400
GAA92309        385    -ADTYGARMDAVPEVGEHNKAILAEL----GL-----DEGTEK---------------------------------------    417
GAQ39945        385    -ADTYGARMDAVPEVGEHNKAILAEL----GL-----DVDAEK---------------------------------------    417
XP_001215477    384    -SANFAARMDAVPAVGEHNESILAEL----GM-----KE--SK---------------------------------------    414
AND01113        384    -SANFTARMDAVPAVGEHNESILAEL-----GM-----KE---SK---------------------------------------    414
XP_015411786    385    -PGRFSARMDAVPDVGEHNAAILAEL----GID----DAGKDS---------------------------------------    418
KJK61899        385    -PGRFSARMDAVPDVGEHNAAILAEL----GIA---DAGEDV---------------------------------------    418
XP_001817553    385    -AGRFSARMDAVPDVGEHNAAILAEL---GIE---DAGEDL---------------------------------------    418
XP_002372659    385    -PGRFSARMDAVPDVGEHNAAILAEL---GIE---DAGEDL---------------------------------------    418
KJJ31924        385    -PGRFSARMDAVPDVGEHNAAILAEL---GIE---DAGEDL---------------------------------------    418
EYE92894        381    -ADGLNARIGAVPNVGEHNEAILAEL----GI------DD-TD---------------------------------------    411
GAO86382        392    -PEGFEAQMGAVPEVGEHNEAILAEL-----GI-----DTDLD----------------------------------------    423
XP_748858       392    -PDGFEAQMGAVPEIGQHNEAILAEL----GI-----DTDIE----------------------------------------    423
XP_001261603    392    -PDGFEAQMGAVPEIGQHNEAILAEL----GM-----DTDIG----------------------------------------    423
CEL03321        388    GNEGVHARMDPVPKVGEHNESILAEL---GI-----TTSNKE----------------------------------------    421
CBF90284        387    -RGGFRPRMDAVPEVGEHNESIFAEL----GP----T---RK---------------------------------------    416
XP_657662       314    -RGGFRPRMDAVPEVGEHNESIFAEL----GF----T---RK---------------------------------------    343
CEL09785        405    ------------PALGQTEEVLKEL---GLS----AEDVSKLRKD----KVI------------------------------    434
XP_001818947    416    ------------PTLGQHTDEILEEILEYG------KDDIARLKQD-----GVVS---------------------------    447
KJK63717        416    ------------PTLGQHTDEILEEILEYG------KDDIARLKQD-----GVVS---------------------------    447
GAA89989        412    ------------PTLGQHTDEILGEVLEYG------KDDIARLKKD-----GVVA---------------------------    443
CBF74899        412    ------------PLLGEHTDEVLMEI---GL----SELEIAGLRKE-----KIVA---------------------------    442
KMK57138        416    ------------PTLGQHTDEILKELLNYD------KADIDLLKKE-----GIVS---------------------------    447
XP_001398966    412    ------------PTLGQHTDEILGELLEYG------KDDIARLKKD----GVVA----------------------------    443
XP_001265042    417    ------------PTLGQHTDEILEELLNYD------KANIELLKKE-----GIVS---------------------------    448
XP_001269532    416    ------------PTLGQHTDEILEEILDYG------KSDIARLKKE-----GVLS---------------------------    447
CEN60056        420    ------------PTLGQHTDEILGEVLQYS------VKEIAQLKKD-----GVVS---------------------------    451
EYE99383        418    ------------PTLGQHTDEILGGI-EYG------KEDIARLKQE-----GVVS---------------------------    448
XP_750374       417    ------------PTLGQHTDEILKELLNYD------KADIDLLKKE-----GIVS---------------------------    448
KEY81259        417    ------------PTLGQHTDEILKELLNYD------KADIELLKKE-----GIVS---------------------------    448
CEL09034        409    ------------PLLGEHTDEILGDM---GL----SEGEIRALRDE-----GVIS---------------------------    439
KKK20152        419    ------------PTLGQHTDEILGQILEYG------AADIAQLKKD-----GVVS---------------------------    450
XP_015405578    417    ------------PTLGQHTDEILEEILEYG---------------GLMSQ-----------------QHGVLPTPAS     449
GAQ44411        412    ------------PTLGQHTDEILGEVLECGVQSKSTKTTEQLCTS--TRLGDMSP-----------------HNGAPSSQAS     462
KKK17524        419    ------------PTLGQHTDEILGQILEYG-------AADIAQLKKDATNPGISTPYRVPRTFSKPAQGMSQQDGVSPSLAS    481
XP_001273489
XP_661834       415    ------------PTLGQHTDEVLGELLQYG------EKQISQLKQD-----GVVS---------------------------    446
XP_001212170    407    ------------PTLGQHTNEILGEILDYG------KDIERLKEQ----GVVA----------------------------    438

XP_001391168           ---------------------------------------------------------------------------------
EHA23704               ---------------------------------------------------------------------------------
GAA92309               ---------------------------------------------------------------------------------
GAQ39945               ---------------------------------------------------------------------------------
XP_001215477           ---------------------------------------------------------------------------------
AND01113               ---------------------------------------------------------------------------------
XP_015411786           ---------------------------------------------------------------------------------
KJK61899               ---------------------------------------------------------------------------------
XP_001817553           ---------------------------------------------------------------------------------
XP_002372659           ---------------------------------------------------------------------------------
KJJ31924               ---------------------------------------------------------------------------------
EYE92894               ---------------------------------------------------------------------------------
GAO86382               ---------------------------------------------------------------------------------
XP_748858              ---------------------------------------------------------------------------------
XP_001261603           ---------------------------------------------------------------------------------
```

Fig. 11(Cont. VIII)

```
CEL03321            ------------------------------------------------------------------------------------
CBF90284            ------------------------------------------------------------------------------------
XP_657662           ------------------------------------------------------------------------------------
CEL09785            ------------------------------------------------------------------------------------
XP_001818947        ------------------------------------------------------------------------------------
KJK63717            ------------------------------------------------------------------------------------
GAA89989            ------------------------------------------------------------------------------------
CBF74899            ------------------------------------------------------------------------------------
KMK57138            ------------------------------------------------------------------------------------
XP_001398966        ------------------------------------------------------------------------------------
XP_001265042        ------------------------------------------------------------------------------------
XP_001269532        ------------------------------------------------------------------------------------
CEN60056            ------------------------------------------------------------------------------------
EYE99383            ------------------------------------------------------------------------------------
XP_750374           ------------------------------------------------------------------------------------
KEY81259            ------------------------------------------------------------------------------------
CEL09034            ------------------------------------------------------------------------------------
KKK20152            ------------------------------------------------------------------------------------
XP_015405578  450   IEPAP-PAHGTSSGWQT----SAPTLERVSPSLSPSL------KPSRPPSAISSKVHIPKLSPATTELVARVTGHRKGETQR   520
GAQ44411      463   IETAPSSAHGTLHTTTTTSGSPPSDSSRSISIGSSLGLPPSLPGRPSSVPSKRVEIPRLSAATTELLARVTGNLKGPQQR   542
KKK17524      482   IEATPPPTYGTLITTTTL-GEHPSTSPIPAHIDSSSRPKSPNSGQSSSATSSKVLIPKLSATTTELLARVAGNIKGTQQQ   560
XP_001273489        ------------------------------------------------------------------------------------
XP_661834           ------------------------------------------------------------------------------------
XP_001212170        ------------------------------------------------------------------------------------

XP_001391168        ------------------------------------------------------------------------------------
EHA23704            ------------------------------------------------------------------------------------
GAA92309            ------------------------------------------------------------------------------------
GAQ39945            ------------------------------------------------------------------------------------
XP_001215477        ------------------------------------------------------------------------------------
AND01113            ------------------------------------------------------------------------------------
XP_015411786        ------------------------------------------------------------------------------------
KJK61899            ------------------------------------------------------------------------------------
XP_001817553        ------------------------------------------------------------------------------------
XP_002372659        ------------------------------------------------------------------------------------
KJJ31924            ------------------------------------------------------------------------------------
EYE92894            ------------------------------------------------------------------------------------
GAO86382            ------------------------------------------------------------------------------------
XP_748858           ------------------------------------------------------------------------------------
XP_001261603        ------------------------------------------------------------------------------------
CEL03321            ------------------------------------------------------------------------------------
CBF90284            ------------------------------------------------------------------------------------
XP_657662           ------------------------------------------------------------------------------------
CEL09785            ------------------------------------------------------------------------------------
XP_001818947        ------------------------------------------------------------------------------------
KJK63717            ------------------------------------------------------------------------------------
GAA89989            ------------------------------------------------------------------------------------
CBF74899            ------------------------------------------------------------------------------------
KMK57138            ------------------------------------------------------------------------------------
XP_001398966        ------------------------------------------------------------------------------------
XP_001265042        ------------------------------------------------------------------------------------
XP_001269532        ------------------------------------------------------------------------------------
CEN60056            ------------------------------------------------------------------------------------
EYE99383            ------------------------------------------------------------------------------------
XP_750374           ------------------------------------------------------------------------------------
KEY81259            ------------------------------------------------------------------------------------
CEL09034            ------------------------------------------------------------------------------------
KKK20152            ------------------------------------------------------------------------------------
XP_015405578  521   N-GTKFVTWNPPSLHPGW-SHPRIQPSG-TMKASSTIIELPTAPFVYSSH-MTTPAVAQQAP-------------------   578
GAQ44411      543   NDNDRFVTWNPSTVTRTFESQNSNSTMG-KMRASSTIIELPTAPFVYSNT-VAPPAVPQPASPAPQGTTGDIVKSTNLPN   620
KKK17524      561   AQRYDQNSGSWTSFPLNPDLNGSNTPVADTMRASSTLIELPTAPFVYSNNKVEPPAVAQKGTSVPPSSNGNSVKPPSLLN   640
XP_001273489        ------------------------------------------------------------------------------------
XP_661834           ------------------------------------------------------------------------------------
XP_001212170        ------------------------------------------------------------------------------------
```

Fig. 11(Cont. IX)

XP_001391168
EHA23704
GAA92309
GAQ39945
XP_001215477
AND01113
XP_015411786
KJK61899
XP_001817553
XP_002372659
KJJ31924
EYE92894
GAO86382
XP_748858
XP_001261603
CEL03321
CBF90284
XP_657662
CEL09785
XP_001818947
KJK63717
GAA89989
CBF74899

Fig. 11(Cont. X)

```
KMK57138          ----------------------------------------------------------------------------
XP_001398966      ----------------------------------------------------------------------------
XP_001265042      ----------------------------------------------------------------------------
XP_001269532      ----------------------------------------------------------------------------
CEN60056          ----------------------------------------------------------------------------
EYE99383          ----------------------------------------------------------------------------
XP_750374         ----------------------------------------------------------------------------
KEY81259          ----------------------------------------------------------------------------
CEL09034          ----------------------------------------------------------------------------
KKK20152          ----------------------------------------------------------------------------
XP_015405578  579 -VTAPPTTSP----STHTYTP-------------PLPQGSHDKPTRL-VNIAPKPAGPPSIGVPAPPQDSLP--------  631
GAQ44411      621 LAPKPPGTTPIDAVSRHSGSPVSVNVDLKPTSSTPVDAVSRQSASPIPVNIAPKPSTTPVGAVLAPTQLTAPTSAELTAE  700
KKK17524      641 IAPKPTLAPP----------------------------------------------------------------SST  653
XP_001273489      ----------------------------------------------------------------------------
XP_661834         ----------------------------------------------------------------------------
XP_001212170      ----------------------------------------------------------------------------

XP_001391168      ----------------------------------------------------------------------------
EHA23704          ----------------------------------------------------------------------------
GAA92309          ----------------------------------------------------------------------------
GAQ39945          ----------------------------------------------------------------------------
XP_001215477      ----------------------------------------------------------------------------
AND01113          ----------------------------------------------------------------------------
XP_015411786      ----------------------------------------------------------------------------
KJK61899          ----------------------------------------------------------------------------
XP_001817553      ----------------------------------------------------------------------------
XP_002372659      ----------------------------------------------------------------------------
KJJ31924          ----------------------------------------------------------------------------
EYE92894          ----------------------------------------------------------------------------
GAO86382          ----------------------------------------------------------------------------
XP_748858         ----------------------------------------------------------------------------
XP_001261603      ----------------------------------------------------------------------------
CEL03321          ----------------------------------------------------------------------------
CBF90284          ----------------------------------------------------------------------------
XP_657662         ----------------------------------------------------------------------------
CEL09785          ----------------------------------------------------------------------------
XP_001818947      ----------------------------------------------------------------------------
KJK63717          ----------------------------------------------------------------------------
GAA89989          ----------------------------------------------------------------------------
CBF74899          ----------------------------------------------------------------------------
KMK57138          ----------------------------------------------------------------------------
XP_001398966      ----------------------------------------------------------------------------
XP_001265042      ----------------------------------------------------------------------------
XP_001269532      ----------------------------------------------------------------------------
CEN60056          ----------------------------------------------------------------------------
EYE99383          ----------------------------------------------------------------------------
XP_750374         ----------------------------------------------------------------------------
KEY81259          ----------------------------------------------------------------------------
CEL09034          ----------------------------------------------------------------------------
KKK20152          ----------------------------------------------------------------------------
XP_015405578  632 ---------------PPLPSHPQPIAPAAKDSPPSAKRKRAAVGPRQRRSTTNGTKR-KKRRRGNDSDGED-IIR  689
GAQ44411      701 IKIAPKPNGT-LSNGAAPASTPLPT-PQEPQPAAK-----SKRPQTAAGSRQRKGAANGNKRGKKRKRNNDSDGED-IIR  772
KKK17524      654 TPVPSQPADTKIQLPPSQPQPPTPATTNPATIKTSSPSGTLTTKQSKAPSNTRQRRSTGTRKRRSKKRRGHDSDDEVIR  733
XP_001273489      ----------------------------------------------------------------------------
XP_661834         ----------------------------------------------------------------------------
XP_001212170      ----------------------------------------------------------------------------
```

Fig. 11(Cont. XI)

```
XP_001391168    ------------------------------------------------------------
EHA23704        ------------------------------------------------------------
GAA92309        ------------------------------------------------------------
GAQ39945        ------------------------------------------------------------
XP_001215477    ------------------------------------------------------------
AND01113        ------------------------------------------------------------
XP_015411786    ------------------------------------------------------------
KJK61899        ------------------------------------------------------------
XP_001817553    ------------------------------------------------------------
XP_002372659    ------------------------------------------------------------
KJJ31924        ------------------------------------------------------------
EYE92894        ------------------------------------------------------------
GAO86382        ------------------------------------------------------------
XP_748858       ------------------------------------------------------------
XP_001261603    ------------------------------------------------------------
CEL03321        ------------------------------------------------------------
CBF90284        ------------------------------------------------------------
XP_657662       ------------------------------------------------------------
CEL09785        ------------------------------------------------------------
XP_001818947    ------------------------------------------------------------
KJK63717        ------------------------------------------------------------
GAA89989        ------------------------------------------------------------
CBF74899        ------------------------------------------------------------
KMK57138        ------------------------------------------------------------
XP_001398966    ------------------------------------------------------------
XP_001265042    ------------------------------------------------------------
XP_001269532    ------------------------------------------------------------
CEN60056        ------------------------------------------------------------
EYE99383        ------------------------------------------------------------
XP_750374       ------------------------------------------------------------
KEY81259        ------------------------------------------------------------
```

Fig. 11(Cont. XII)

```
CEL09034          --------------------------------------------------------------------------
KKK20152          --------------------------------------------------------------------------
XP_015405578  690 AGDSSSDESDVAPTATQTKSGRQVNRPSLYVPPSASPTVAKDSSNSLDTSDNTQRQVAAARKRKRVYRKPKDGI-ISCIH 768
GAQ44411      773 AGDSSSDESDVAPTATQTKSGRLVNRPSLYVPAPSAPAVAKEVSNSADASD-----YAAIARKRKRIHRRGKDAI-ITCLH 847
KKK17524      734 AGDSSSDESDFTPTATQTKSGRHVNRPSLYMPTPASPAAIKENGNTLGGSDKLH---EASRKRRRVFRKGKDANNITCVH 810
XP_001273489      --------------------------------------------------------------------------
XP_661834         --------------------------------------------------------------------------
XP_001212170      --------------------------------------------------------------------------

XP_001391168      --------------------------------------------------------------------------
EHA23704          --------------------------------------------------------------------------
GAA92309          --------------------------------------------------------------------------
GAQ39945          --------------------------------------------------------------------------
XP_001215477      --------------------------------------------------------------------------
AND01113          --------------------------------------------------------------------------
XP_015411786      --------------------------------------------------------------------------
KJK61899          --------------------------------------------------------------------------
XP_001817553      --------------------------------------------------------------------------
XP_002372659      --------------------------------------------------------------------------
KJJ31924          --------------------------------------------------------------------------
EYE92894          --------------------------------------------------------------------------
GAO86382          --------------------------------------------------------------------------
XP_748858         --------------------------------------------------------------------------
XP_001261603      --------------------------------------------------------------------------
CEL03321          --------------------------------------------------------------------------
CBF90284          --------------------------------------------------------------------------
XP_657662         --------------------------------------------------------------------------
CEL09785          --------------------------------------------------------------------------
XP_001818947      --------------------------------------------------------------------------
KJK63717          --------------------------------------------------------------------------
GAA89989          --------------------------------------------------------------------------
CBF74899          --------------------------------------------------------------------------
KMK57138          --------------------------------------------------------------------------
XP_001398966      --------------------------------------------------------------------------
XP_001265042      --------------------------------------------------------------------------
XP_001269532      --------------------------------------------------------------------------
CEN60056          --------------------------------------------------------------------------
EYE99383          --------------------------------------------------------------------------
XP_750374         --------------------------------------------------------------------------
KEY81259          --------------------------------------------------------------------------
CEL09034          --------------------------------------------------------------------------
KKK20152          --------------------------------------------------------------------------
XP_015405578  769 CQRGHSPQSNAIVFCYECHGPWHQLCHDPPIEPQVVTVTMKQRPWVCRECKPVPITIMQPTVVRSNPSLTGPSFGP--PV 846
GAQ44411      848 CQRGHSPLSNSIVFCDECNAAWHQLCHDPPIGADVVAV--KEKEWFCRECRPVEISVIQPTVVRSNPDLTS---GPLVPN 922
KKK17524      811 CQRGHSPQSNAIVFCDECNRAWHQRCHDPPIENDVIAV--KEKEWICLECKPVKISITHPTVVRSNPTLTSASLPP--PV 886
XP_001273489      --------------------------------------------------------------------------
XP_661834         --------------------------------------------------------------------------
XP_001212170      --------------------------------------------------------------------------
```

Fig. 11(Cont. XIII)

```
XP_001391168          ------------------------------------------------------------------
EHA23704              ------------------------------------------------------------------
GAA92309              ------------------------------------------------------------------
GAQ39945              ------------------------------------------------------------------
XP_001215477          ------------------------------------------------------------------
AND01113              ------------------------------------------------------------------
XP_015411786          ------------------------------------------------------------------
KJK61899              ------------------------------------------------------------------
XP_001817553          ------------------------------------------------------------------
XP_002372659          ------------------------------------------------------------------
KJJ31924              ------------------------------------------------------------------
EYE92894              ------------------------------------------------------------------
GAO86382              ------------------------------------------------------------------
XP_748858             ------------------------------------------------------------------
XP_001261603          ------------------------------------------------------------------
CEL03321              ------------------------------------------------------------------
CBF90284              ------------------------------------------------------------------
XP_657662             ------------------------------------------------------------------
CEL09785              ------------------------------------------------------------------
XP_001818947          ------------------------------------------------------------------
KJK63717              ------------------------------------------------------------------
GAA89989              ------------------------------------------------------------------
CBF74899              ------------------------------------------------------------------
KMK57138              ------------------------------------------------------------------
XP_001398966          ------------------------------------------------------------------
XP_001265042          ------------------------------------------------------------------
XP_001269532          ------------------------------------------------------------------
CEN60056              ------------------------------------------------------------------
EYE99383              ------------------------------------------------------------------
XP_750374             ------------------------------------------------------------------
KEY81259              ------------------------------------------------------------------
CEL09034              ------------------------------------------------------------------
KKK20152              ------------------------------------------------------------------
XP_015405578   847    HAPLILPKTEVGGEGFSADERRGFLSGLSHATLVELLVTLSDQHPAVPMFPKNLKTLQ-SKFSPKPNTLAVPTPSS-TSS    924
GAQ44411       923    YPPLSIPKGEVGAAEFSADERRGFLSGLSHATLVELLMTISDNNPILPMFPEDMRDLQSSKFAPRLPISDAPTPST-SVS   1001
KKK17524       887    HTPPALPKIEVAGERPTADDQRRFLSGLSHATLVELLLAISDRNPTVPIFPEHLKTLPLSNFPFSHTIMTTTAATVLTPS    966
XP_001273489          ------------------------------------------------------------------
XP_661834             ------------------------------------------------------------------
XP_001212170          ------------------------------------------------------------------
```

Fig. 11(Cont. XIV)

| | | | |
|---|---|---|---|
| XP_001391168 | | | |
| EHA23704 | | | |
| GAA92309 | | | |
| GAQ39945 | | | |
| XP_001215477 | | | |
| AND01113 | | | |
| XP_015411786 | | | |
| KJK61899 | | | |
| XP_001817553 | | | |
| XP_002372659 | | | |
| KJJ31924 | | | |
| EYE92894 | | | |
| GAO86382 | | | |
| XP_748858 | | | |
| XP_001261603 | | | |
| CEL03321 | | | |
| CBF90284 | | | |
| XP_657662 | | | |
| CEL09785 | | | |
| XP_001818947 | | | |
| KJK63717 | | | |
| GAA89989 | | | |
| CBF74899 | | | |
| KMK57138 | | | |
| XP_001398966 | | | |
| XP_001265042 | | | |
| XP_001269532 | | | |
| CEN60056 | | | |
| EYE99383 | | | |
| XP_750374 | | | |
| KEY81259 | | | |
| CEL09034 | | | |
| KKK20152 | | | |
| XP_015405578 | 925 | NTPTITNSINHALT----DGVDMAQHKSGVTPEFLPTPSSAHQTQHDLSEESEYEFSEHRLYPRAGNGFRLSTKADDVDIM | 1001 |
| GAQ44411 | 1002 | GNVSTSNDTRDSTS----ASTEVNKHNEDSVPDATSSSSTRRRYEEISDDDSEYEFQEHRLYPRAGNGFRLSLNVDDMDIM | 1078 |
| KKK17524 | 967 | PSVSTNTAPVTSTSNNSASTPSAETDKPSVEPASEPTGKKRHHYESSDDESEYDFQDHRLYPRAGNGIQLSTNPEDLDIM | 1046 |
| XP_001273489 | | | |
| XP_661834 | | | |
| XP_001212170 | | | |

Fig. 11(Cont. XV)

```
XP_001391168        ---------------------------------
EHA23704            ---------------------------------
GAA92309            ---------------------------------
GAQ39945            ---------------------------------
XP_001215477        ---------------------------------
AND01113            ---------------------------------
XP_015411786        ---------------------------------
KJK61899            ---------------------------------
XP_001817553        ---------------------------------
XP_002372659        ---------------------------------
KJJ31924            ---------------------------------
EYE92894            ---------------------------------
GAO86382            ---------------------------------
XP_748858           ---------------------------------
XP_001261603        ---------------------------------
CEL03321            ---------------------------------
CBF90284            ---------------------------------
XP_657662           ---------------------------------
CEL09785            ---------------------------------
XP_001818947        ---------------------------------
KJK63717            ---------------------------------
GAA89989            ---------------------------------
CBF74899            ---------------------------------
KMK57138            ---------------------------------
XP_001398966        ---------------------------------
XP_001265042        ---------------------------------
XP_001269532        ---------------------------------
CEN60056            ---------------------------------
EYE99383            ---------------------------------
XP_750374           ---------------------------------
KEY81259            ---------------------------------
CEL09034            ---------------------------------
KKK20152            ---------------------------------
XP_015405578  1002  WEDVSCRTFSYALHGPARARAQANEVAPIWGS  1033
GAQ44411      1079  REDPACPTFSYSLHGPAQVRAQLNEMVPVWGT  1110
KKK17524      1047  QEDPACPTFSYTLHKRAQA-------------  1065
XP_001273489        ---------------------------------
XP_661834           ---------------------------------
XP_001212170
```

Fig. 12

Blast results with itaconyl-CoA hydratase (citramalyl-CoA hydro-lyase)
  An07g09220, ATEG_03709
  An17g02190, ATEG_09462

Alignments itaconyl-CoA hydratase / citramalyl-CoA hydro-lyase EC 4.2.1.56

| | | |
|---|---|---|
| EHA24296.1 | hypothetical protein ASPNIDRAFT_180396[Aspergillus niger ATCC 1015](SEQ ID NO:84) |
| XP_001391996.1 | hypothetical protein ANI_1_2118064 [Aspergillus niger CBS 513.88](SEQ ID NO:85) |
| GAQ38857.1 | C6 transcription factor [Aspergillus niger] (SEQ ID NO:86) |
| GAA85522.1 | C6 transcription factor [Aspergillus kawachii IFO 4308](SEQ ID NO:87) |
| GAT20200.1 | C6 transcription factor [Aspergillus luchuensis](SEQ ID NO:88) |
| XP_002373724.1 | conserved hypothetical protein [Aspergillus flavus NRRL3357](SEQ ID NO:89) |
| XP_001818485.2 | hypothetical protein AOR_1_2752174 [Aspergillus oryzae RIB40](SEQ ID NO:90) |
| AND01114.1 | itaconyl-CoA hydratase [Aspergillus terreus](SEQ ID NO:91) |
| KOC07272.1 | hypothetical protein AFLA70_512g000590 [Aspergillus flavus AF70](SEQ ID NO:92) |
| XP_001212887.1 | conserved hypothetical protein [Aspergillus terreus NIH2624](SEQ ID NO:93) |
| XP_001267876.1 | conserved hypothetical protein [Aspergillus clavatus NRRL 1](SEQ ID NO:94) |
| XP_015408044.1 | hypothetical protein ANOM_004786 [Aspergillus nomius NRRL 13137](SEQ ID NO:95) |
| GAQ03415.1 | hypothetical protein ALT_0736 [Aspergillus lentulus](SEQ ID NO:96) |
| EYE99654.1 | hypothetical protein EURHEDRAFT_25178 [Aspergillus ruber CBS 135680](SEQ ID NO:97) |
| XP_001257844.1 | hypothetical protein NFIA_052930 [Aspergillus fischeri NRRL 181](SEQ ID NO:98) |
| EDP49294.1 | conserved hypothetical protein [Aspergillus fumigatus A1163](SEQ ID NO:99) |
| XP_662795.1 | hypothetical protein AN5191.2 [Aspergillus nidulans FGSC A4](SEQ ID NO:100) |
| GAO87784.1 | hydroxyacyl-thioester dehydratase type 2,mitochondrial[Aspergillus udagawae](SEQ ID NO:101) |
| XP_750618.1 | conserved hypothetical protein [Aspergillus fumigatus Af293](SEQ ID NO:102) |
| CEN61370.1 | hypothetical protein ASPCAL08024 [Aspergillus calidoustus](SEQ ID NO:103) |
| KIA75732.1 | hypothetical protein HK57_00467 [Aspergillus ustus](SEQ ID NO:104) |

Fig. 12 (Cont. I)

```
EHA24296        1    MSL-PSITRSSTRTLLRPQTVTPQLTRAFSI---RPALRT---DTSAS-------TIATSFLTRFQSLGPQTRSQILDANQLR    69
XP_001391996    1    MSL-PSITRCSTRHLLRPQSLTPQLTRTFSI---RPALRT---DTSAS-------TIATSFLTRFQSLGPQTRSQTLDANQLQ    69
GAQ38857        1    MSL-PSLARHSTRSLLRPQSLPPQLTRAFSN---RPALRT-----SASAS-----TIATTPLTRFQSLGPQARTQTLDANQLQ    69
GAA85522        1    MSL-PSLARHSTRPLLRPQSLPPQLTRAFSN---RPALRT---NTSASAS----SIATSFLTRFQSLGPQTRSQTLDANQLQ    71
GAT20200        1    MSL-PSLARHSTRPLLRPQSLPPQLTRAFSN---RPALRT---NTSASAS----SIATSFLTRFQSLGPQTRSQTLDANQLQ    71
XP_002373724    1    MSL---SSAVQGARHSNQNLFRGCSSPRRFSV--HHCRRSVADSSAT-------SIAASFLSRFQSLGPQTRSQFLDANQLQ    70
XP_001818485    1    MSL---SSAVQGARHSNQNLFRGCSSFRRFSV--HHCRRSVADSSAT-------SIAASFLSRFQSLGPQTRSQFLDANQLQ    70
AND01114        1    MSI---HTSARWAMRSVPPLSQGCAALRRFSV--QHACRSASEATAP-------SVAASFLSRFQSMGPQTRSQVLDANQLQ    70
KOC07272        1    MSL---SSAVQGARHSNQNLFRGCSSFRRFSV--HHCRRSVADSSAT-------SIAASFLSRFQSLGPQTRSQFLDANQLQ    70
XP_001212887    1    MSI---HTSARWAMRSVPPLTQGCAALRRFSV--QHSCRSAPEATAP-------SVAASFLSRFQSMGPQTRSQVLDANQLQ    70
XP_001267876    1    MSVRPGLTQRC----------ST----SRHFSVLHRRLCSQ--SDSAS-------TIARSFLSRFQSLGPQTRIQILDSNQLQ    60
XP_015408044    1    MSL---SSTVQWARYSNQNLFRGCSSFRRFSV--HHGRCSAADSSAS-------ATAASFLSRFQSLGPQTRSQFLDANQLQ    70
GAQ03415        1    MSVRSRLACQSGRFVSKGYTPS----ARQFST-HGQRCSP--SDSAS-------SIAASFLSRFNSLGPQTRTQVIDSNQLQ    68
EYE99654        1    MLF-LRPTLRTAHFLYR---------KRLPST------SPG--KTSAS-------SIAPSFLERFQSLGPQIRTQALDANQLQ    58
XP_001257844    1    MSVRTRLACQSRRFVSKGYTPS----ARQFST-HGQRCSQ--SDSAS-------SIAASFLSRFNSLGPQTRTQVLDSNQLQ    68
EDP49294        1    MSVRTRLACQSRRFVSKGYTRS----ARQFSA-HGQRCSQ--SDSAS-------SIAASFLSRFNSLGPQTRTQVLDSNQLL    68
XP_662795       1    MLISRPVTRGTTRTLPTRLIPL--ACLRPFSS---------STSDASAS----SIATSFLSRFQSLGPQTRTQTLDANQLR    65
GAO87784        1    MSVGTRLAFQSGRFLSKGYTAS----ARQFST-HGLLCSQ--SDSAS-------SIAASFLACFNSLGPQTRTQVLDSNQLQ    68
XP_750618       1    MN--------RSRRFVSKGYTRS----ARQFSA-HGQRCSQ--SDSAS-------SIAASFLSRFNSLGPQTRTQVLDSNQLL    61
CEN61370        1    MTMLLTTATRPSRLLTKHLRNL------RFS-------SSS---STSAST------IASSFLNRFQSLGPQIRTQTLDPNQLR    61
KIA75732        1    --MLLTATIRPSRPLTKHLRGL------RFS-------SSS---SSSASASASASAIAASFLDRFQSLGPQIRTQTLDPNQLR    65

EHA24296       70    LLSLTLNRPSLFPNSPSLSNTPTS----------LPTGTPLPAGYHLVYFTPAFLENELGADGTDTSYNPASPFTRRMWA   139
XP_001391996   70    LLSLTLNRPSLFPNSPSLSNTPTS----------LPTGTPLPAGYHLVYFTPAFLENELGADGTDTSYNPASPFTRRMWA   139
GAQ38857       70    LLSLTLNRPSLFPKSPSLSNTPTS----------LPTGTPLPAGYHLVYFTPAFLENELGADGTDTSYNPASPFTRRMWA   139
GAA85522       72    LLSLTLNRPSLFPNSPSLSNTPTS----------LPTGTPLPAGYHLVYFTPAFLENELGADGTDTSYNPASPFTRRMWA   141
GAT20200       72    LLSLTLNRPSLFPNSPSLSNTPTS----------LPTGTPLPAGYHLVYFTPAFLENELGADGTDTSYNPASPFTRRMWA   141
XP_002373724   71    LLSLTLNRPSLYPDTPSLSNASTS----------IPAGTPLPPGYHLVYFTPAFLEDELGADGTDASYNPETPFTRRMWA   140
XP_001818485   71    LLSLTLNRPSLYPDTPSLSNASTS----------IPAGTPLPPGYHLVYFTPAFLEDELGADGTDASYNPETPFTRRMWA   140
AND01114       71    LLSLTLNRPSLYPNSPSLSNASGV----------VPTGTPLPPAYHLVYFTPAFLEGELGADGTDVSYNPEAPFTRRMWA   140
KOC07272       71    LLSLTLNRPSLYPDTPSLSNASTS----------ILAGTPLPGYHLVYFTPAFLEDELGADGTDASYNPETPFTRRMWA    140
XP_001212887   71    LLSLTLNRPSLYPNSPSLSNASGV----------VPTGTPLPPAYHLVYFTPAFLEGELGADGTDVSYNPEPPFTRRMWA   140
XP_001267876   61    LLSLTLNRPSLFPNSPSLSHASAS----------LQRGTPLPAGYHLVYFTPAFLETELGADGTDVSYNPEAPFTRRMWA   130
XP_015408044   71    LLSLTLNRPSLYPDTPSLSHASTS----------LPAGTPLPGYHLVYFTPAFLENELGADGTDVSYNPETPFTRRMWA    140
GAQ03415       69    LLSLTLNRPTLYPNSPVFTNASAS----------LQQGTPLPAGYHLVYFTPAFLESELGADGTDVSYNPETPFTRRMWA   138
EYE99654       59    LLTFTLNRPSLYPNISSLSNNTTP----------PPAGTPLPPGYHLVYFTPAFLENELGADGTDVSYNPASPFTRRMWA   128
XP_001257844   69    LLSLTLNRPTVYPNSPVLTNASAS----------LQQGTPLPAGYHLVYFTPTFLESELGADGTDVSYNPETPFTRRMWA   138
EDP49294       69    LLSLTLNRPTLHPNSPVLTTASGS----------LQQGTPLPAGYHLVYFTPTFLETELGADGTDVSYNPDTPFTRRMWA   138
XP_662795      66    LLSLTLNRPSLLPTTPHLSQLATA----SNQCEIEVANGTPLPAGYHLAYFTPAFLENELGADGTDTSYNPAHPFTRRMWA   142
GAO87784       69    LLSLTLNRPTLYPNSPVLTNASAS----------LPQGIPLPAGYHLVYFTPAFLESELGADGTDVSYNPETPFTRR---   135
XP_750618      62    LLSLTLNRPTLHPNSPVLTTASGS----------LQQGTPLPAGYHLVYFTPTFLETELGADGTDVSYNPDTPFTRRMWA   131
CEN61370       62    LLSLTLNRSSLFPSLPALSSTTTPTADNAIDTEVSAGTPLPPGYHLVYFTPAFLETELGADGTDTSYNPSHPFTRRMWA   141
KIA75732       66    LLSLTLNRPSLFPSSSPLSSTTTDAPAANVAGTEIAAGTPLPPGYHLVYFTPAFLETELGSDGTDTSYNPSHPFTRRMWA   145

EHA24296      140    GGEVEWPRGKDGKP-NYLRVGQEVQETTRVLSAEPKVVRKTGEEMIVVGVEKEFRNEDGVAVLDR----------------   203
XP_001391996  140    GGEVEWPRGKDGKP-NCLRVGQEVQETTRVLSAEPKVVRKTGEEMIVVGVEKEFRNENGVAVLDR----------------   203
GAQ38857      140    GGEVEWPRGKDGKP-NYLRVGQEVQETTRVLSAEPKVVRKTGEEMIVVGVEKEFRNEDGVAVLDRRRVGIVPCEVGNGAD   218
GAA85522      142    GGEVEWPRGKDGKP-NYLRVGQEVQETTRVLSAEPKVVRKTGEEMIVVGVEKEFRNEDGVAVLDR----------------   205
GAT20200      142    GGEVEWPRGKDGKP-NYLRVGQEVQETTRVLSAEPKVVRKTGEEMIVVGVEKEFRNEDGVAVLDR----------------   205
XP_002373724  141    GGEVEWPRAADGSP-NPLLVGQEVQETTRVLSAEPKVVRKTGEEMIVVGVEKEFRNEHGVAVIDR----------------   204
```

Fig. 12 (Cont. II)

```
XP_001818485   141  GGEVEWPRAADGSP-NPLLVGQEVQETTRVLSAEPKVVRKTGEEMIVVGVEKEFRNEHGVAVIDR----------------  204
AND01114       141  GGEVQWPRGADGKP-NPLRVGQEVQETTRVLSAEPKIIRKTGDEMIVVSVEKEFRNEHGVAVIDR----------------  204
KOC07272       141  GGEVEWPRAADGSP-NPLLVGQEVQETTRVLSAEPKVVRKTGEEMIVVGVEKEFRNEHGVAVIDR----------------  204
XP_001212887   141  GGEVQWPRGADGKP-NPLRVGQEVQETTRVLSAEPKIIRKTGDEMIVVSVEKEFRNEHGVAVIDR----------------  204
XP_001267876   131  GGEVQWPRGSDGKP-NPLCVGQEVQETTRVLSAEPKVVRKTGEEMIVVGVEKEFRNDKGVAVLDRR---------------  195
XP_015408044   141  GGEVEWPRAADGSP-NPLRVGQEVQETTKVLSAEPKIVRKTGEEMIVVGVEKEFRNEHGVAVIDR----------------  204
GAQ03415       139  GGEVQWPRGPDGMP-NPLRVGQEIQETTRVLSAEPKTVRRTGEEMIVVGVEKEFRNEHGVAVLDRR---------------  203
EYE99654       129  GGEVQWPRGIKGRV-NPLRVGQEVTETTRVLSAEPKVVKKTGEEMIVVSVEKEFRNEEGVAVLDR----------------  192
XP_001257844   139  GGEVQWPRGPDGMP-NPLRVGQEIQETTRVLSAELKIVRRTGEEMIVVGVEKEFRNEHGDTVNGNR----------TWRT  207
EDP49294       139  GGEVQWPRGPDGMP-NPLRVGQEIQETTRVLSAEPKIVRRTGEEMIVVGVEKEFRNEHGVAVLDR----------------  203
XP_662795      143  GGEVCWPRDSNGSV-NPLRVGEKVTETTRVLSAEAKTVRKTGEEMIVVGVEKEFSNEAGVAVIDR----------------  206
GAO87784       136  --------------------QEIQETTRVLSADPKIVRRTGEEMIVVGVEKEFRNEHGVAVLDRR---------------  180
XP_750618      132  GGEVQWPRGPDGMP-NPLRVGQEIQETTRVLSAEPKIVRRTGEEMIVVGVEKEFRNEHGVAVLDRR---------------  196
CEN61370       142  GGEVSWPRDGSGRA-NPLRVGQRVTETTRVLSAEPKVVRKTGEEMIVVGVEKEFANEGGVAVVDR----------------  205
KIA75732       146  GGEVSWQRDASGGAVNPLRVGQKVTETTRVLSAEPKIVKKTGEEMIVVGVEKEFANEGGVAVVDR----------------  210

EHA24296       204  -----RNWVFRKALTSPS-------PTSSSTPPATKA-F-NGPASSSTETSEN--VHTRTLRQTAVTLFRFSALTFNPHKIHY  270
XP_001391996   204  -----RNWVFRKALTSPS-------PTSSSTPPATKA-F-NGPASSSTETSEN--VHTRTLRQTAVTLFRFSALTFNPHKIHY  270
GAQ38857       219  KNVYRNWVFRKALTSPS-------PTASSTPPATKA-F-NGPASSSTQTSDN--VHTRTLRQTAVTLFRFSALTFNPHKIHY  289
GAA85522       206  -----RNWVFRKALTSPS-------PTTSSTPPATKA---PNGPASSSTQTSDN--VHTRTLRQTAVTLFRFSALTFNPHKIHY  272
GAT20200       206  -----RNWVFRKALTSPS-------PTTSSTPPATKA-F-NGPASSSTQTSDN--VHTRTLRQTAVTLFRFSALTFNPHKIHY  272
XP_002373724   205  -----RNWVFRKALAVPS-------VSSKTTNNPAPL--PSAPASSSTVSTAK---THIRTLRQTAVTLFRFSALTFNPHKIHY  271
XP_001818485   205  -----RNWVFRKALAVPS-------VSSKTTNNPAPL--PSAPASSSTVSTAK---THIRTLRQTAVTLFRFSALTFNPHKIHY  271
AND01114       205  -----RNWVFRKALTLAS-------SPVSASPISVHL---PALPASCSTSTVGK---THTRTLRQTAVTLFRFSALTFNPHKIHY  271
KOC07272       205  -----RNWVFRKALAVPS-------VSSKTTNNPAPL--PSAPASSSTVSTAK---THIRTLRQTAVTLFRFSALTFNPHKIHY  271
XP_001212887   205  -----RNWVFRKALALAS-------SPVSASPISVHL---PALPASCSTSTVGK---THTRTLRQTAVTLFRFSALTFNPHKIHY  271
XP_001267876   196  ------NWVFRKAF-PPS-------STSKAADLLDPA-RPSGPATSTTAATGN---THTRTLRQTAVTLFRFSALTFNPHKIHY  261
XP_015408044   205  ----RNWVFRKALAVPS-------VSS-TASDPAPL--PSAPASSSTVSAAK---THTRTLRQTAVTLFRFSALTFNPHKIHY  270
GAQ03415       204  ------NWVFRKAL-APS-------SSSVSTNLLDPI-TPSGPAFSKTSTTGS--VHTRTMKQTAVTLFRFSALTFNPHKIHY  269
EYE99654       193  ----RNWVFRKALPIPS-------TASSSTTPSSQQWTPPQPASCITTTSGS---THTRLRQTPVTLFRFSALTFNPHKIHY  261
XP_001257844   208  TNGTRNWVFRKAL-APS-------SSSVSTNLPDPI-TPSGPAFSKTSTTGN---VHTRTMKQTAVTLFRFSALTFNPHKIHY  278
EDP49294       204  ------NWVFRKAL-SPS-------SAAASTNLPDPI-TPSGPAFSKTSTIGN---VHTRTMKQTAVTLFRFSALTFNPHKIHY  269
XP_662795      207  -----RNWVFRKALPPPS-----IQQTQDLPPPTPP--SSLPATSTTTSSPDGLTHTRTLRQTAVTLFRFSALTFNPHKIHY  276
GAO87784       181  ------NWVFRKAL-STS-------SSSVSTNLPDPI-TPSGPAFSKTSTTSN--VHTRTMKQTAVSLFRFSALTFNPHKIHY  246
XP_750618      197  ------NWVFRKAL-SPS-------SAAASTNLPDPI-TPSGPAFSKTSTIGN---VHTRTMKQTAVTLFRFSALTFNPHKIHY  262
CEN61370       206  ----RNWVFRKALPPLTPSTTAEASSTLPPPSPP--TPHPATSTTTSTGN---THTRTLTQTAVTLFRFSALTFNPHKIHY  277
KIA75732       211  ----RNWVFRKALPPPTSSTTASSSSTLPPASPP--TPHPASCTTISSGN---THTRTLSQTAVTLFRFSALTFNPHKIHY  282

EHA24296       271  STPWARDVEGHKDIVVHGPLNLISILHLWRDTR-----KN-----GSGEEVVLPEKISYRATSPLYAEEEYRIVL-EDGEDG  341
XP_001391996   271  STPWARDVEGHKDIVVHGPLNLISILDLWRDTR-----KN-----GSGEEVVLPEKISYRATSPLYAEEEYRIVL-EDGEDG  341
GAQ38857       290  STPWARDVEGHKDIVVHGPLNLISILDLWRDTR-----KN-----EGGE-LVLPEKISYRATSPLYAEEEYRIVL-EDGGDG  359
GAA85522       273  STLWARDVEGHKDIVVHGPLNLISILDLWRDTR-----KHE------GGELVLPEKISYRATSPLYAEDEYRIVL-EDGGDG  342
GAT20200       273  STLWARDVEGHKDIVVHGPLNLISILDLWRDTR-----KH-----EGGE-LVLPEKISYRATSPLYAEDEYRIVL-EDGGDG  342
XP_002373724   272  STPWAQQMEGHRDIVVHGPLNLISILDLWRDTR-----SNK----S-DPASMLPESITYRATSPLYAEDKYQIVLDEEEGLG  343
XP_001818485   272  STPWAQQMEGHRDIVVHGPLNLISILDLWRDTR-----SNK----S-DPASMLPESITYRATSPLYAEDKYQIVLDEEEGLG  343
AND01114       272  STPWARDVEGHKDIVVHGPLNLISILDLWRDTR-----ADS----ATDSSLLLPESISYRATSPLYAEETYRIVLDEERGDS  344
KOC07272       272  STPWAQQMEGHRDIVVHGPLNLISILDLWRDTR-----SNK----S-DPASMLPESITYRATSPLYAEDKYQIVLDEEEGLG  343
XP_001212887   272  STPWARDVEGHKDIVVHGPLNLISILDLWRDTR-----ADS----ATDSSLLLPESISYRATSPLYAEETYRIVLDEEQGDG  344
XP_001267876   262  SLPWSRGVEGHKDIVVHGPLNLINILDLWRDTR-----VS-----ATQHSELVLPQSISYRATSPLYAEEEYQIVL-ED-ADN  332
XP_015408044   271  STPWAQQMEGHRDLVVHGPLNLISILDLWRDTR-----PNT----A-DPASMLPESITYRATSPLYAEDEYQIVLDEEEGSG  342
GAQ03415       270  SLPWARDVEGHRDIVVHGPLNLINILDLWRDTR-----ASTL-ASESPELILPSISYRATSPLYAEEEYRIVL-ED-EDS  342
EYE99654       262  SVPWARDVEGHKDIVVHGPLNLISILDLWRDTR-----SQN--TEAGLEALVPESIKYRATSPLYAEDEYRIVL-EE-SDG  333
XP_001257844   279  SLPWARDVEGHRDIVVHGPLNLINILDLWRDTR-----TSTL-ASEAPELILPQSISYRATSPLYAEEEYRIVL-ED-EDS  351
EDP49294       270  SLPWARDVEGHRDIVVHGPLNLINILDLWRDTR-----TATL-ASEAPELILPQSISYRATSPLYAEEEYRIIL-ED-EDS  342
XP_662795      277  SQPWCRQVEGHKDIVVHGPLNLIAILDFWRDVR-----SSACGADVDANTPLPDRITYRATSPLYAEEEYRIVL-KKGEGE  351
GAO87784       247  SLPWARDVEGHRDIVVHGPLNLINILDLWRDTR-----TSTL-ISEGPELILPQSISYRATSPLYAEEEYRIVL-ED-QDG  319
XP_750618      263  SLPWARDVEGHRDIVVHGPLNLINILDLWRDTR-----TATL-ASEAPELILPQSISYRATSPLYAEEEYRIIL-EE-A--  333
CEN61370       278  SLPWARDVEGHRDIVVHGPLNLISILDLWRDLRGADGRDGS-----LDLLYPESISYRATSPLYAGDEYRIVL-EEKEG-  350
KIA75732       283  SLPWARDVEGHRDIVVHGPLNLISILDLWRDLRGADGSDGS-----LDTLYPEKISYRATSPLYAGDEYRIVL-EEGQGK  356
```

Fig. 12 (Cont. III)

```
EHA24296       342  IGR----VQIVAP-GEVVAMKAEIQ--------------------------------------------------  361
XP_001391996   342  IGR----VQIIAP-GEVVAMKAEIQ--------------------------------------------------  361
GAQ38857       360  VGK----VQIVAP-GEVVAMKAEIQ--------------------------------------------------  379
GAA85522       343  VGR----VQIVAP-GEVVAMKAEIQL-----KCCRTHPCTNCLKRNEAGTCTFIGRGPRGKTSSNGRTSPTQVQDRLQHLEN  414
GAT20200       343  VGR----VQIVAP-GEVVAMKAEIQ--------------------------------------------------  362
XP_002373724   344  VGA----VQILAP-GGQVAMKAEVR---SAK--------------------------------------------  366
XP_001818485   344  VGA----VQILAP-GGQVAMKAEVRWRGNVKLLEILGYEDTSRFRAI----------------------------  385
AND01114       345  VSR----VQIFTP-DEKVAMKAEIR--------------------------------------------------  364
KOC07272       344  VGA----VQILAP-GGQVAMKAEVR---SAK--------------------------------------------  366
XP_001212887   345  VSR----VQIFTP-DEKVAMKAEIR--------------------------------------------------  364
XP_001267876   333  VSK----VQILGPDGVTVAMKAEVR---------------FESVA------------------------------  358
XP_015408044   343  IGT----VQIIAP-GGTVAMKAEVR---SAE--------------------------------------------  365
GAQ03415       343  IAK----VQVIGPDGMTVAMKAEIK---------------S----------------------------------  364
EYE99654       334  VGN----VQILAP-GDVVGMKAEIS--------------------------------------------------  353
XP_001257844   352  IAK----VQVIGPDGMTIAMKAEIK---------------G----------------------------------  373
EDP49294       343  IAK----VQVIGPDGKTVAMKADIK---------------S----------------------------------  364
XP_662795      352  DGKKSAVEIITP-EGNVGMKAEVVG---------------V----------------------------------  376
GAO87784       320  VAN----VQVIGPDGMTVAMKAEIK---------------S----------------------------------  341
XP_750618      334  ---------------STGQGSLIL----------------R----------------------------------  343
CEN61370       351  KGV----VEILTA-DGRTAMKAGITS--------------V----------------------------------  372
KIA75732       357  KGI----VEILTP-EGTIGMKAEIVG--------------V----------------------------------  378

EHA24296            --------------------------------------------------------------------------
XP_001391996        --------------------------------------------------------------------------
GAQ38857            --------------------------------------------------------------------------
GAA85522       415  LILSFTQQQQQQQQQERSNSVGEHQQVINNGGQITPASSVQPSLAFGEVQQAQGGDSETPPPDPGRLVVRETGMRYIDGA  494
GAT20200            --------------------------------------------------------------------------
XP_002373724        --------------------------------------------------------------------------
```

Fig. 12 (Cont. IV)

| | | | |
|---|---|---|---|
| XP_001818485 | | --- | |
| AND01114 | | --- | |
| KOC07272 | | --- | |
| XP_001212887 | | --- | |
| XP_001267876 | | --- | |
| XP_015408044 | | --- | |
| GAQ03415 | | --- | |
| EYE99654 | | --- | |
| XP_001257844 | | --- | |
| EDP49294 | | --- | |
| XP_662795 | | --- | |
| GAO87784 | | --- | |
| XP_750618 | | --- | |
| CEN61370 | | --- | |
| KIA75732 | | --- | |
| | | | |
| EHA24296 | | --- | |
| XP_001391996 | | --- | |
| GAQ38857 | | --- | |
| GAA85522 | 495 | HWSAILEEISGVKEYLRENEELGLSDEEGEDDEMVRPSNAPTLLLGLHQEMTMDELLDGLPARPVVDRVVAMFVGLNEPT | 574 |
| GAT20200 | | --- | |
| XP_002373724 | | --- | |
| XP_001818485 | | --- | |
| AND01114 | | --- | |
| KOC07272 | | --- | |
| XP_001212887 | | --- | |
| XP_001267876 | | --- | |
| XP_015408044 | | --- | |
| GAQ03415 | | --- | |
| EYE99654 | | --- | |
| XP_001257844 | | --- | |
| EDP49294 | | --- | |
| XP_662795 | | --- | |
| GAO87784 | | --- | |
| XP_750618 | | --- | |
| CEN61370 | | --- | |
| KIA75732 | | --- | |
| | | | |
| EHA24296 | | --- | |
| XP_001391996 | | --- | |
| GAQ38857 | | --- | |
| GAA85522 | 575 | TVMVEFPTFQKQYNQFWQRPKEVSISWLALLYAALTITMSVYMRTGEPLPAEFGEADEAVQRLRQLTAQCLVQSNYTVPG | 654 |
| GAT20200 | | --- | |
| XP_002373724 | | --- | |
| XP_001818485 | | --- | |
| AND01114 | | --- | |
| KOC07272 | | --- | |
| XP_001212887 | | --- | |
| XP_001267876 | | --- | |
| XP_015408044 | | --- | |
| GAQ03415 | | --- | |
| EYE99654 | | --- | |
| XP_001257844 | | --- | |
| EDP49294 | | --- | |
| XP_662795 | | --- | |
| GAO87784 | | --- | |
| XP_750618 | | --- | |
| CEN61370 | | --- | |
| KIA75732 | | --- | |

Fig. 12 (Cont. V)

```
EHA24296
XP_001391996
GAQ38857
GAA85522      655   RFKVEALFFYTMCEFFRSEDAQVGVSFLLNMAIRLAMRSGYHRDPQHFPNITPYEGEMRRRVWAIMRQLDVLISFQVGVP   734
GAT20200
XP_002373724
XP_001818485
AND01114
KOC07272
XP_001212887
XP_001267876
XP_015408044
GAQ03415
EYE99654
XP_001257844
EDP49294
XP_662795
GAO87784
XP_750618
CEN61370
KIA75732

EHA24296
XP_001391996
GAQ38857
GAA85522      735   RGIQDWQQDVELPRNISDEEFGESTVELPPSRPETELSTTAYIRGKSRLMAVFGKISDLAYSRDPMTYDDILALDRQLEE   814
GAT20200
XP_002373724
```

Fig. 12 (Cont. VI)

```
XP_001818485        ----------------------------------------------------------------------------------
AND01114            ----------------------------------------------------------------------------------
KOC07272            ----------------------------------------------------------------------------------
XP_001212887        ----------------------------------------------------------------------------------
XP_001267876        ----------------------------------------------------------------------------------
XP_015408044        ----------------------------------------------------------------------------------
GAQ03415            ----------------------------------------------------------------------------------
EYE99654            ----------------------------------------------------------------------------------
XP_001257844        ----------------------------------------------------------------------------------
EDP49294            ----------------------------------------------------------------------------------
XP_662795           ----------------------------------------------------------------------------------
GAO87784            ----------------------------------------------------------------------------------
XP_750618           ----------------------------------------------------------------------------------
CEN61370            ----------------------------------------------------------------------------------
KIA75732            ----------------------------------------------------------------------------------

EHA24296            ----------------------------------------------------------------------------------
XP_001391996        ----------------------------------------------------------------------------------
GAQ38857            ----------------------------------------------------------------------------------
GAA85522      815   ARDLVPTAFKIRPLDQCFVDSSYLILRRYTLELLYQKARCVLHRRYLGEVHTNPRYAYSRQVCMSASKEILRHQADIYHE   894
GAT20200            ----------------------------------------------------------------------------------
XP_002373724        ----------------------------------------------------------------------------------
XP_001818485        ----------------------------------------------------------------------------------
AND01114            ----------------------------------------------------------------------------------
KOC07272            ----------------------------------------------------------------------------------
XP_001212887        ----------------------------------------------------------------------------------
XP_001267876        ----------------------------------------------------------------------------------
XP_015408044        ----------------------------------------------------------------------------------
GAQ03415            ----------------------------------------------------------------------------------
EYE99654            ----------------------------------------------------------------------------------
XP_001257844        ----------------------------------------------------------------------------------
EDP49294            ----------------------------------------------------------------------------------
XP_662795           ----------------------------------------------------------------------------------
GAO87784            ----------------------------------------------------------------------------------
XP_750618           ----------------------------------------------------------------------------------
CEN61370            ----------------------------------------------------------------------------------
KIA75732            ----------------------------------------------------------------------------------

EHA24296            ----------------------------------------------------------------------------------
XP_001391996        ----------------------------------------------------------------------------------
GAQ38857            ----------------------------------------------------------------------------------
GAA85522      895   TQPGGLLYRDRQFPNSLQTADYLLAAMIICLDLSQNPTGTPTGSTDEDVAAVIRSREELLATIKTSHRIFEQQRRRSADA   974
GAT20200            ----------------------------------------------------------------------------------
XP_002373724        ----------------------------------------------------------------------------------
XP_001818485        ----------------------------------------------------------------------------------
AND01114            ----------------------------------------------------------------------------------
KOC07272            ----------------------------------------------------------------------------------
XP_001212887        ----------------------------------------------------------------------------------
XP_001267876        ----------------------------------------------------------------------------------
XP_015408044        ----------------------------------------------------------------------------------
GAQ03415            ----------------------------------------------------------------------------------
EYE99654            ----------------------------------------------------------------------------------
XP_001257844        ----------------------------------------------------------------------------------
EDP49294            ----------------------------------------------------------------------------------
XP_662795           ----------------------------------------------------------------------------------
GAO87784            ----------------------------------------------------------------------------------
XP_750618           ----------------------------------------------------------------------------------
CEN61370            ----------------------------------------------------------------------------------
KIA75732            ----------------------------------------------------------------------------------
```

Fig. 12 (Cont. VII)

```
EHA24296        ----------------------------------------------------------------------------------
XP_001391996    ----------------------------------------------------------------------------------
GAQ38857        ----------------------------------------------------------------------------------
GAA85522    975 QKAYVALTIMLRRINFQQQESQQLTSAQPPLYGSWNGQPYSVGVDPMGITPEYQALDVIGEMLDAPTNLDWNLWDQQMQC 1054
GAT20200        ----------------------------------------------------------------------------------
XP_002373724    ----------------------------------------------------------------------------------
XP_001818485    ----------------------------------------------------------------------------------
AND01114        ----------------------------------------------------------------------------------
KOC07272        ----------------------------------------------------------------------------------
XP_001212887    ----------------------------------------------------------------------------------
XP_001267876    ----------------------------------------------------------------------------------
XP_015408044    ----------------------------------------------------------------------------------
GAQ03415        ----------------------------------------------------------------------------------
EYE99654        ----------------------------------------------------------------------------------
XP_001257844    ----------------------------------------------------------------------------------
EDP49294        ----------------------------------------------------------------------------------
XP_662795       ----------------------------------------------------------------------------------
GAO87784        ----------------------------------------------------------------------------------
XP_750618       ----------------------------------------------------------------------------------
CEN61370        ----------------------------------------------------------------------------------
KIA75732        ----------------------------------------------------------------------------------

EHA24296         ---------------------
XP_001391996     ---------------------
GAQ38857         ---------------------
GAA85522    1055 AANTDVGLWGDNIPEAVNI 1073
GAT20200         ---------------------
XP_002373724     ---------------------
```

Fig. 12 (Cont. VIII)

```
XP_001818485    ----------------------
AND01114        ----------------------
KOC07272        ----------------------
XP_001212887    ----------------------
XP_001267876    ----------------------
XP_015408044    ----------------------
GAQ03415        ----------------------
EYE99654        ----------------------
XP_001257844    ----------------------
EDP49294        ----------------------
XP_662795       ----------------------
GAO87784        ----------------------
XP_750618       ----------------------
CEN61370        ----------------------
KIA75732        ----
```

Fig. 13

Blast results with citramalyl-CoA lyase

An01g08610, ATEG_03186/

Allignments citramalyl-CoA lyase EC 4.1.3.25

EHA26713.1      citrate lyase [Aspergillus niger ATCC 1015] (SEQ ID NO:105)
XP_001389283.1  citrate lyase beta subunit [Aspergillus niger CBS 513.88](SEQ ID NO:106)
GAQ34176.1      citrate lyase beta subunit [Aspergillus niger] (SEQ ID NO:107)
GAA81947.1      citrate lyase beta subunit [Aspergillus kawachii IFO 4308](SEQ ID NO:108)
XP_001816766.1  citrate lyase beta subunit [Aspergillus oryzae RIB40] (SEQ ID NO:109)
XP_001266741.1  citrate lyase beta subunit, putative [Aspergillus fischeri NRRL 181](SEQ ID NO:110)
XP_001272157.1  citrate lyase beta subunit, putative [Aspergillus clavatus NRRL 1](SEQ ID NO:111)
GAQ08417.1      citrate lyase subunit beta-like protein, mitochondrial[Aspergillus lentulus](SEQ ID NO:112)
XP_002383307.1  citrate lyase beta subunit, putative [Aspergillus flavus NRRL3357](SEQ ID NO:113)
GAO83300.1      citrate lyase subunit beta-like protein, mitochondrial [Aspergillus udagawae](SEQ ID NO:114)
KJK62363.1      HpcH/HpaI aldolase/citrate lyase family protein [Aspergillus parasiticus SU-1](SEQ ID NO:115)
KEY82626.1      citrate lyase beta subunit [Aspergillus fumigatus var. RP-2014](SEQ ID NO:116)
XP_751528.1     citrate lyase beta subunit [Aspergillus fumigatus Af293](SEQ ID NO:117)
KKK26201.1      citrate lyase beta subunit [Aspergillus rambellii] (SEQ ID NO:118)
KKK12001.1      citrate lyase beta subunit [Aspergillus ochraceoroseus] (SEQ ID NO:119)
XP_015411338.1  citrate lyase beta subunit [Aspergillus nomius NRRL 13137](SEQ ID NO:120)
EYE92804.1      putative citrate lyase beta subunit [Aspergillus ruber CBS 135680](SEQ ID NO:121)
XP_001212364.1  conserved hypothetical protein [Aspergillus terreus NIH2624] (SEQ ID NO:122)
AND01115.1      citramalyl-CoA lyase [Aspergillus terreus](SEQ ID NO:123)
CEN59788.1      Putative Citrate lyase [Aspergillus calidoustus](SEQ ID NO:124)
XP_661181.1     hypothetical protein AN3577.2 [Aspergillus nidulans FGSC A4](SEQ ID NO:125)

Fig. 13 (Cont. I)

```
EHA26713       1   ---------------MAARNTLRRALLY-------------IPGSSQRFIDKSRTLTADCVAYDLEDSVTPHKKAEARSLVR   54
XP_001389283   1   ---------------MAARNTLRRALLY-------------IPGSSQRFIDKSRTLTADCVAYDLEDSVTPHKKAEARSLVR   54
GAQ34176       1   ---------------MAARNTLRRALLY-------------IPGSSQRFIDKSRTLTADCVAYDLEDSVTPHKKAEARSLVR   54
GAA81947       1   ---------------MAARNTLRRALLY-------------IPGSSQRFIDKSRTLTADCVAYDLEDSVTPHKKAEARSLVR   54
XP_001816766   1   ---------------MASRNALRRALLY-------------IPGSSQRFIDKSRTLTADCVAYDLEDSVTPHKKAEARSLVR   54
XP_001266741   1   ---------------MASRNTLRRALLY-------------IPGSSQRFIDKSRSLTADCVAYDLEDSVTPHKKAEARSLVR   54
XP_001272157   1   ---------------MASRNTLRRALLY-------------IPGSSQRFIDKSRSLTADCVAYDLEDSVTPYKKAEARSLVR   54
GAQ08417       1   ---------------MASRNTLRRALLY-------------IPGSSQRFIDKSRSLTADCVAYDLEDSVTPHKKAEARSLVR   54
XP_002383307   1   ---------------MASRNALRRALLY-------------IPGSSQRFIDKSRTLTADCVAYDLEDSVTPHKKAEARSLVR   54
GAO83300       1   ---------------MASRNTLRRALLY-------------IPGSSQRFIDKSRSLTADCVAYDLEDSVTPHKKAEARSLVR   54
KJK62363       1   ---------------MASRNALRRALLY-------------IPGSSQRFIDKSRTLTADCVAYDLEDSVTPHKKAEARSLVR   54
KEY82626       1   ---------------MASRNTLRRALLY-------------IPGSSQRFIDKSRSLTADCVAYDLEDSVTPHKKAEARSLVR   54
XP_751528      1   MLFT-----------MASRNTLRRALLY-------------IPGSSQRFIDKSRSLTADCVAYDLEDSVTPHKKAEARSLVR   58
KKK26201       1   ---------------MASRNALRRALLY-------------IPGSSQRFIDKSRTLSVDCVAYDLEDSVAPHMKAEARSLVR   54
KKK12001       1   ---------------MASRNALRRALLY-------------IPGSSQRFIDKSRTLSVDCVAYDLEDSVAPHMKAEARSLVR   54
XP_015411338   1   LNRSVSSDNGVQKYAPSRIALQRTTSLTPRRPSLTLNNPVPGSSQRFIDKSRTLTADCVAYDLEDSVTPHKKAEARSLVR     80
EYE92804       1   ---------------MATRNALRRSLLY-------------IPGSSQRFIDKSRTLSADCIAYDLEDSVTPHKKIEARGLVR   54
XP_001212364   1   ---------------MASRNTLRRALLY-------------IPGSSQRFIDKSRTLTADCVAYDLEDSVTPHKKAEARSLVR   54
AND01115       1   ---------------MASRNTLRRALLY-------------IPGSSQRFIDKSRTLTADCVAYDLEDSVTPHKKAEARSLVR   54
CEN59788       1   ---------------MAARNTLRRALLY-------------IPGSSQRFIDKSRSLAADCVAYDLEDSVTPHKKAEARSLVR   54
XP_661181      1   ---------------MAARNTLRRALLY-------------IPGSSQRFITKSRSLTADCVAYDLEDSVTPHKKAEARSLVR   54

EHA26713       55  RALDEPAPQGIRERAVRINSVDSGLALGDLTEVLKSPNLTTIVIPKVNTPSDLTFVNDVITHTLSQQ----QQ--D---P    125
XP_001389283   55  RALDEPAPQGIRERAVRINSVDSGLALGDLTEVLKSPNLTTIVIPKVNTPSDLTFVNDVITHTLSQQ----QQ-QD---P    126
GAQ34176       55  RALDEPAPQGIRERAVRINSVDSGLALGDLTEVLKSPNLTTIVIPKVNTPSDLTFVNDVITHTLSQQ----QQTQD---P    127
GAA81947       55  RALDEPAPQGIRERAVRINSVDSGLALGDLTEVLKSPNLTTIVIPKVNTPSDLTFVNDVITHTLSQQ----QQTQD---P    127
XP_001816766   55  RALDQPAPSGIRERAVRINSVDSGLALADLTEVLQSPNLSTVVIPKVNSASDLTFVNDVITHTLSQQ---PQS---Q---D  126
XP_001266741   55  RALDQPAPSGIRERAVRINSVDSGLALADLTEVLQSPNLSTIVIPKVNSASDLTFVTDVVSHTLSQQ---AHS---Q---D  126
XP_001272157   55  RALDQPAPSGIRERAVRINSVDSGLALADLTEVLQSPNLSTIVIPKVNSASDLTFVTDVITHTISQK----SQT--Q---D  126
GAQ08417       55  RALDQPAPSGIRERAVRINSVDSGLALADLTEVLQSPNLSTIVIPKVNSASDLTFVTDVISHTLSQQ---AHS---Q---D  126
XP_002383307   55  RALDQPAPSGIRERAVRINSVDSGLALADLTEVLQSPNLSTVVIPKVNSASDLTFVNDVITHTLSQQ---PQS---Q---D  126
GAO83300       55  RALDQPAPSGIRERTVRINSVDSGLALADLTEVLQSPNLSTIVIPKVNSASDLTFVTDVISHTLSQQ---PHS---Q---D  126
KJK62363       55  RALDQPAPSGIRERAVRINSVDSGLALADLTEVLQSPNLSTIVIPKVNSASDLTFVNDVITHTLSQQ---PQS--H---D   126
KEY82626       55  RALDLPAPSGIRERAVRINSVDSGLALADLTEVLQSPNLSTIVIPKVNSASDLTFVTDVVSHTLSQQ---ARS---Q---D  126
XP_751528      59  RALDLPAPSGIRERAVRINSVDSGLALADLTEVLQSPNLSTIVIPKVNSASDLTFVTDVVSHTLSQQ---ARS---Q---D  130
KKK26201       55  RALDQPVPAGIRERAVRINSVNSGLALSDLTEVLKSPNLTTIVIPKVNSASDLTFVTDVINHTLSQSQAPPQS---QAEAD  132
KKK12001       55  RALDQPVPAGIRERAVRINSVNSGLALSDLTEVLKSPNLTTIVIPKVNSASDLTFVTDVINHTLSQSQAPPQS---QAEAD  132
XP_015411338   81  RALDQPAPSGIRERAVRINSVDSGLALADLTEVLQSPNLSTIVIPKVNSASDLTFVNDVITHTLSQQ---PQS---Q---D  152
EYE92804       55  RALDQPAPEGIRERAVRINSVDSGLALGDLTEVLQSPNLSTIVLPKVNSPSDLTFVTDVISHTLSQQ----QQQ--Q---Q  126
XP_001212364   55  RALDQPAPTGILERAVRINSVDSGLALADLTEVLQSPNLSTIVIPKVNSASDLTFVNDVITHTLSQL----PPS--Q----  125
AND01115       55  RALDQPAPAGILERAVRINSVDSGLALADLTEVLQSPNLSTIVIPKVNSASDLTFVNDVITHTLSQL----PLS--Q----  125
CEN59788       55  RALDEPAPASIRERAVRINSVDSGLALADLTEVLKSPNLSTIVIPKVNSASDLTFVTDVIHHTLAQQ---ATQ---A---Q  126
XP_661181      55  RALDEPAPPSIRERAVRINSVDSGLALADLTEVLKSPNLSTIVIPKVNSASDLTFVNDVITHTLAQQ-----E--A---Q   124

EHA26713       126 -----S-TP--RPPISLLALVESAKSLTNLTQICASTPLLQGLIFAAEDFALDLSITRTPSLTEFLFARSMIATAARAANL   198
XP_001389283   127 -----S-TP--RPPISLLALVESAKSLTNLTQICASTPLLQGLIFAAEDFALDLSITRTPSLTEFLFARSMIATAARAANL   199
GAQ34176       128 -----S-TP--RTPISLLALVESAKSLTNLTQICASTPLLQGLIFAAEDFALDLSITRTPSLTEFLFARSMIATAARAANL   200
GAA81947       128 -----S-TP--RTPISLLTLVESAKSLTNLTQICASTPLLQGLIFAAEDFALDLSITRTPSLTEFLFARSMIATAARAANL   200
```

Fig. 13 (Cont. II)

```
XP_001816766  127  ----A-SS--RPPISLLALVESAKSLTNLTQICASTPLLQGLIFAAEDFALDLSLTRTPDLTEFLFARSMIATAARAANL  199
XP_001266741  127  ----A-AS--RPPISLLALVESAKSLTNLTQICAATPLLQGLIFAAEDFALDLSLTRTPSLTEFLFARSAIVTAARAANL  199
XP_001272157  127  ----G-HP--RPPISLLALVESAKSLTNLTQICAATPLLQGLIFAAEDFALDLSLTRTPSLMEFLFARSAIVTAARAANL  199
GAQ08417      127  ----A-AA--RPPISLLALVESAKSLTNLTQICAATPLLQGLIFAAEDFALDLSLTRTPSLTEFLFARSAIVTAARAANL  199
XP_002383307  127  ----A-SS--RPPISLLALVESAKSLTNLTQICASTPLLQGLIFAAEDFALDLSLTRTPDLTEFLFARSMIATAARAANL  199
GAO83300      127  ----A-AS--RPPISLLALVESAKSLTNLTQICAATPLLQGLIFAAEDFALDLSLTRTPSLTEFLFARSAIVTAARAANL  199
KJK62363      127  ----A-SS--RPPISLLALVESAKSLTNLTQICASTPLLQGLIFAAEDFALDLSLTRTPDLTEFLFARSMIATAARAANL  199
KEY82626      127  ----A-AS--RPPLSLLALVESAKSLTNLTQICAATPLLQGLIFAAEDFALDLSLTRTPSLTEFLFARSAIVTAARAANL  199
XP_751528     131  ----A-AS--RPPLSLLALVESAKSLTNLTQICAATPLLQGLIFAAEDFALDLSLTRTPSLTEFLFARSAIVTAARAANL  203
KKK26201      133  ----ALAS--RPPISLLALVESAKSLTNLTHICSATPLLQGLIFAAEDFALDLSLTRTPALTEFLFARSAIVTAARAADL  206
KKK12001      133  ----ALAS--RPPISLLALVESAKSLTNLTHICSATPLLQGLIFAAEDFALDLSLTRTPALTEFLFARSAIVTAARAADV  206
XP_015411338  153  ----A-SS--RPPISLLALVESAKSLTNLTQICASTPLLQGLIFAAEDFALDLSLTRTPDLTEFLFARSMIATAARAANL  225
EYE92804      127  QHQQV-QQ--RPPVSLLALVESAKSLTNLTQICSASPLLQGLIFAAEDFALDLSLTRTPALTEFLFARSMIATAARAANL  203
XP_001212364  126  ----T-TS--RPPISLLALVESAKSLTNLSQICAASPLLQGLIFAAEDFALDLSLTRTPALTEFLFARSAIATAARAANL  198
AND01115      126  ----S-AS--RPPISLLALVESAKSLTNLSQICAASPLLQGLIFAAEDFALDLSLTRTPALTEFLFARSAIATAARAANL  198
CEN59788      127  ----S-PQQERPPISLLALIESAKSITNLPQITAATPYLQGLIFAAEDFALDLSLTRTPSLTEFLFARSAIATAARAANL  201
XP_661181     125  ----G-LPVTKSPISLLALVESAKSLTNLTSITSATPLLQGLIFAAEDFALDLSLTRTPSLTEFLFARSAIATAARAANL  199

EHA26713      199  PSTIDLVCTAYKSTKGDGSPPAVLEEECRDGRRLGFNGKQCIHPSQVETAQAIFGPDPEEVKWAVRVCVADEKAARAGRG  278
XP_001389283  200  PSTIDLVCTAYKSTKGDGSPPAVLEEECRDGRRLGFNGKQCIHPSQVETAQAIFGPDPEEVKWAVRVCVADEKAARAGRG  279
GAQ34176      201  PSTIDLVCTAYKSTKGDGSPPAVLEEECRDGRRLGFNGKQCIHPSQVETAQAIFGPDPEEVKWAVRVCVADEKAARAGRG  280
GAA81947      201  PSTIDLVCTAYKSTKGDGSPPAVLEEECRDGRRLGFNGKQCIHPSQVETAQAIFGPDPEEVKWAVRVCVADEKAARAGRG  280
XP_001816766  200  PSTIDLVCTTYKSTKGDGSPPAVLEEECRGGRQLGFNGKQCIHPSQVPTVQQIFGPDSDEVQWAVRVTIADDKAAAAGRG  279
XP_001266741  200  PSTIDLVCTAYKSTKGDGSPPAALEEECRGGKQLGFNGKQCIHPSQVETAQRIFGPEPAEVEWAVRVTIADEKAAKAGRG  279
XP_001272157  200  PSTIDLVCTAYKSTKGDGSPPAVLEEECRSGKQLGFNGKQCIHPSQVETAQRIYGPETDEVQWAVRVVIADEKAAQAGRG  279
GAQ08417      200  PSAIDLVCTAYKSTKGDGSPPAVLEEECRGGKQLGFNGKQCIHPSQVETAQRIFGPEPAEVEWAVRVTIADEKAAKAGRG  279
XP_002383307  200  PSTIDLVCTTYKSTKGDGSPPAVLEEECRGGRQLGFNGKQCIHPSQVPTVQQIFGPDSDEVQWAVRVTIADDKAAAVGRG  279
GAO83300      200  PSTIDLVCTAYKSTKGDGSPPAVLEEECRGGKQMGPNGKQCIHPSQVETVQRIFGPEPAEVQWAVRVTIADEKAAKAGRG  279
KJK62363      200  PSTIDLVCTTYKSTKGDGSPPAVLEEECRGGRQLGFNGKQCIHPSQVPTVQQIFGPDSDEVQWAVRVTIADDKAAAAGRG  279
KEY82626      200  PSTIDLVCTAYKSTKSDGSPPAALEEECRGGKQLGFNGKQCIHPSQVETAQRIFGPEPAEVEWAVRVTIADEKAAKAGRG  279
XP_751528     204  PSTIDLVCTAYKSTKSDGSPPAALEEECRGGKQLGFNGKQCIHPSQVETAQRIFGPEPAEVEWAVRVTIADEKAAKAGRG  283
KKK26201      207  PSTIDLVCTTYKSTKADGSPPAVLEEECRGGRGLGFNGKQCIHPSQVETVQAIYGPDPEEVQWAVRTAIADEKAARAGRG  286
KKK12001      207  PSTIDLVCTTYKSTKADGSPPAVLEEECRGGRGLGFNGKQCIHPSQVETVQAIYGPDPEEVQWAVRTAIADEKAARAGRG  286
XP_015411338  226  PSTIDLVCTTYKSTKGDGSPPAVLEEECRGGRQLGFNGKQCIHPSQVPTVQQIFGPDSDEVQWAVRVTIADDKAAAAGRG  305
EYE92804      204  PSTIDLVCTAYKSTTGDGRPPAALEEECRGGKHLGFNGKQCIHPSQVETVERIFGPEDKEVEWAVRVKIADEQAAAAGRG  283
XP_001212364  199  PSTIDLVCTTYKSDKADGSPPAVLQQECRDGKNLGFNGKQCIHPSQVSTVQQIFGPELEEVQWAVRVTIADDKAAKAGRG  278
AND01115      199  PSTIDLVCTTYKSDKGDGSPPVVLQQECRDGKNLGFNGKQCIHPSQVSTVQQIFGPELEEVQWAVRVTIADDKASKAGRG  278
CEN59788      202  PSTIDLVCTTYKSDKGDGSPPAVLEDECRGGRGLGFNGKQCIHPSQVETVQRIYGPDVEEVTWAVRVVIADEKAARAGRG  281
XP_661181     200  PSTIDLVCTTYKSNSGDGKPPAQLEEECRGGRGLGFNGKQCIHPSQVETVQRIYGPDEEEVNWAIRVVVADEKAARQGRG  279

EHA26713      279  AWTLDGKMIDVPVAEKARAVVRKAEACGFDVGKLREEWGHQEPE  322
XP_001389283  280  AWTLDGKMIDVPVAEKARAVVRKAEACGFDVGKLREEWGHQEPE  323
GAQ34176      281  AWTLDGKMIDVPVAEKARAVVRKAEACGFDVGGLREEWGHQEPE  324
GAA81947      281  AWTLDGKMIDVPVAEKARAVVRKAEACGFDVGGLREEWGHQEPE  324
XP_001816766  280  AWTLDGKMIDVPVAEKARAIVKKAEACGFNVEELREKWRDQEPE  323
XP_001266741  280  AWTLDGKMIDIPVAEKARAIVKKAEACGFDVKELQDKWQHQEPE  323
XP_001272157  280  AWTLDGKMIDIPVAEKARSIVKKAEACGFDVRELREKWQHQEPE  323
GAQ08417      280  AWTLDGKMIDIPVAEKARAIVKKAQACGFDVEELQDKWRHQEPE  323
XP_002383307  280  AWTLDGKMIDVPVAEKARAIVKKAEACGFNVEELREKWRDQEPE  323
GAO83300      280  AWTLDGKMIDIPVAEKARAIVKKAEACGFDVEELQDKWRHQEPE  323
KJK62363      280  AWTLDGKMIDVPVAEKARAIVKKAVACGFNVEELREKWRDQEPE  323
KEY82626      280  AWTLDGKMIDIPVAEKARAIVKKAGACGFNVKELQDKWQHQEPE  323
XP_751528     284  AWTLDGKMIDIPVAEKARAIVKKAGACGFNVKELQDKWQHQEPE  327
KKK26201      287  AWTLDGKMIDVPVAAKARAIVKRAEACGFNVGELREKWKGQEPA  330
KKK12001      287  AWTLDGKMIDVPVAAKARAIVKRAEACGFNVGELREKWKGQEPA  330
XP_015411338  306  AWTLDGKMIDVPVAEKARAIVKKAEACGFNVEELREKWRDQEPE  349
EYE92804      284  AWTLDGKMIDVPVAEKARAIVKKAEACGFNVHELREKWQHQEPE  327
XP_001212364  279  AWTLDGKMIDIPVAEKARAIVKKADACGFNVQELREKWQHQEPE  322
AND01115      279  AWTLDGKMIDIPVAEKARAIVKKADACGFNVQELREKWQHQEPE  322
CEN59788      282  AWTLDGKMIDVPVAEKAKSIVKKAEACDFDVAALKKKWRDQEPE  325
XP_661181     280  AWTL
```

Fig. 14

Blast results with trans-aconitate 2-methyltransferase
ATEG_04223, An16g06510

```
Alignments trans-aconitate 2-methyltransferase EC 2.1.1.144
EHA22176.1hypothetical protein ASPNIDRAFT_40903 [Aspergillus niger ATCC 1015](SEQ ID NO:126)
XP_001397953.2  trans-aconitate 2-methyltransferase [Aspergillus niger CBS 513.88](SEQ ID NO:127)
CAK46985.1unnamed protein product [Aspergillus niger](SEQ ID NO:128)
GAA85154.1trans-aconitate 2-methyltransferase [Aspergillus kawachii IFO 4308](SEQ ID NO:129)
GAT24206.1trans-aconitate 2-methyltransferase [Aspergillus luchuensis](SEQ ID NO:130)
GAQ43382.1trans-aconitate 2-methyltransferase [Aspergillus niger](SEQ ID NO:131)
XP_001213401.1  trans-aconitate 2-methyltransferase [Aspergillus terreus NIH2624](SEQ ID NO:132)
XP_002372575.1  trans-aconitate 2-methyltransferase, putative [Aspergillus flavus NRRL3357](SEQ ID NO:133)
XP_001817493.2  trans-aconitate 2-methyltransferase [Aspergillus oryzae RIB40](SEQ ID NO:134)
XP_015403552.1  trans-aconitate 2-methyltransferase [Aspergillus nomius NRRL 13137](SEQ ID NO:135)
KJK61809.1Methyltransferase domain protein [Aspergillus parasiticus SU-1](SEQ ID NO:136)
KKK27392.1hypothetical protein ARAM_002279 [Aspergillus rambellii](SEQ ID NO:137)
KKK18725.1hypothetical protein AOCH_002406 [Aspergillus ochraceoroseus](SEQ ID NO:138)
CEL08721.1Putative Trans-aconitate methyltransferase [Aspergillus calidoustus](SEQ ID NO:139)
EYE90801.1putative trans-aconitate 2-methyltransferase [Aspergillus ruber CBS 135680](SEQ ID NO:140)
CBF78820.1TPA: conserved hypothetical protein [Aspergillus nidulans FGSC A4](SEQ ID NO:141)
XP_680493.1     hypothetical protein AN7224.2 [Aspergillus nidulans FGSC A4](SEQ ID NO:142)
EYE90700.1S-adenosyl-L-methionine-dependent methyltransferase [Aspergillus ruber CBS 135680](SEQ ID NO:143)

EHA22176       1  --------------M-------------------------SDWSATQYLKFADERAIPTQDLLAHIPLQSPSHIVDLGCGP  42
XP_001397953   1  ---------------MFRPRLPLSPHRFSHLRSH----PAKTSDWSATQYLKFADERAIPTQDLLSHIPLQSPSHIVDLGCGP  64
CAK46985       1  ---------------MFRPRLPLSPHRFSHLRSH----PAKTSDWSATQYLKFADERAIPTQDLLSHIPLQSPSHIVDLGCGP  64
GAA85154       1  ---------------MFRPRLSLTPQRITQLLTH----PAKMSDWSATQYLKFADERAIPTQDLLSHIPLQSPSHIVDLGCGP  64
GAT24206       1  ----------------------------------------MSDWSATQYLKFADERAIPTQDLLSHIPLQSPSHIVDLGCGP  42
GAQ43382       1  ----------------------------------------MSDWSATQYLKFADERAIPTQDLLSHIPLQSPSHIVDLGCGP  42
XP_001213401   1  MST-----------------------------------AKPTTTKDWSASQYLKFADERTLPARELLARVPLEAPKTIVDLGCGP  50
XP_002372575   1  ----------------------------------------MSKNDWSATQYLKFEDERTMPARDLLARVPLQAPRRVVDLGCGP  44
XP_001817493   1  MFTYTQSLFTRSALLSGKSSLTQLSHERALSFSSRVMSKNDWSATQYLKFEDERTMPARDLLARVPLQAPRRVVDLGCGP  80
XP_015403552   1  ----------------------------------------MSTNDWSATQYLKFEDERTMPARDLLARVPLQAPRRIVDLGCGP  44
KJK61809       1  ----------------------------------------MSKNDWSATQYLKFEDERTMPARDLLARVPLQAPRRVVDLGCGP  44
KKK27392       1  MLPVPIPKALSGLLPPG--SFRRGFHRSRIN-------MATKDWSAQQYLKFEAERTRPSRDLLAQVPLKSPKRIVDLGCGP  73
KKK18725       1  MLPVPIPKALSGLLPPG--SFRRGFHRSRIN-------MATKDWSAQQYLKFEAERTRPSRDLLAQVPLKSPKRIVDLGCGP  73
CEL08721       1  MLPSS--RTTSHLLPRA--LTVRHFPTR--T------MATKDWSAQQYLKFEAERTRPSRDLLSQIPLKSPKRVVDLGCGP  69
EYE90801       1  ----------------------------------------MAQADWSASQYLKFMNERTTPARDLLARVPLQDPETIVDLGCGP  44
CBF78820       1  -------MSFTARSLRQVLTSTSRNFHCSR-------TMAASDWSARQYLKFEAERTRPARDLLAQVPLDSPHRVVDLGCGP  68
XP_680493      1  -------MSFTARSLRQVLTSTSRNFHCSR-------TMAASDWSARQYLKFEAERTRPARDLLAQVPLDSPHRVVDLGCGP  68
EYE90700       1  -----------------------------------MSSTKDQWSAEAYSASASFVPKLTQKLLSYLVPQPTDKILDVGCGD  46
```

Fig. 14 (Cont. I)

```
EHA22176        43   GNSTAMLSARYPSCPSISGIDSSPNMIARAKES---SNNNTTFAVADVETYSPPT----NHPVDLFFSNAVLHWLPR---STR   115
XP_001397953    65   GNSTAMLSARYPSCPSISGIDSSPNMIARAKES---SNNNTTFAVADVETYSPPP----NQPVDLFFSNAVLHWLPR---STR   137
CAK46985        65   GNSTAMLSARYPSCPSISGIDSSPNMIARAKES---SNNNTTFAVADVETYSPPP----NQPVDLFFSNAVLHWLPR---STR   137
GAA85154        65   GNSTAMLSARYPSCPSIAGIDSSPNMIARAKESSTSTSNTTFAVADVESYSPPP----DHPVDLFFSNAVLHWLPR---STR   139
GAT24206        43   GNSTAMLSARYPSCPSIAGIDSSPNMIARAKESSTSTSNTTFAVADVESYSPPP----DHPVDLFFSNAVLHWLPR---STR   117
GAQ43382        43   GNSTAMLSARYPSCPSIAGIDSSPNMIARAKESSTSTSNTTFAVADVESYSPPP----DHPVDLFFSNAVLHWLPR---STR   117
XP_001213401    51   GNSTAVLAARYP-GAHIVGLDSSPDMIQKAKST----LPEIDFRVADLRSYTPSS------PTDLFFSNAVLQWLRR---DER   119
XP_002372575    45   GNSTAVLATRYP-DAHIVGMDSSPDMIQKAKAT----LPAYEFSVEDLRSYSPPP------SVDLFFSNAVFQWLKK---EER   113
XP_001817493    81   GNSTAVLATRYP-DAHIVGMDSSPDMIQKAKAT----LPAYEFSVEDLRSYSPPP------SVDLFFSNAVFQWLKK---EER   149
XP_015403552    45   GNSTAVLATRYP-DAHIVGMDSSPDMIQKAKSS----LPAYEFSVEDLRSYSPPP------SVDLFFSNAVFQWLKK---EER   113
KJK61809        45   GNSTAVLATRYP-DAHIVGMDSSPDMIQKAKAT----LPAYEFSVEDLRSYSPPP------SVDLFFSNAVFQWLKK---EER   113
KKK27392        74   GNSTAVLLSRYP-GSHVTGIDSSPDMIRKARSA----IPNIEFTVQDLRAYSPDE------PVDLFFSNAVFQWLSR---SDR   142
KKK18725        74   GNSTAVLLSRYP-GSHVTGIDSSPDMIRKARSA----IPNIEFTVQDLTAYSPDE------PVDLFFSNAVFQWLSR---SDR   142
CEL08721        70   GNSTAVLLKQYP-DAHLTGMDSSPDMIRKASAT----LPNIEFTVEDLNTYTPQE------PVDVFFSNAVFQWIPR---KER   138
EYE90801        45   GNSTAVLAHRYP-NAHLVGMDSSPDMIKKAQST----LPSLEFTVEDLRTYSPPQ------SVDLFFSNAVLHWLGR---DER   113
CBF78820        69   GNSTAVLVSRYP-DARVTGMDSSPDMIGKARET----LPGIEFTVDGLSTYTPRE------PVDLFFSNAVFQWLPR---DQR   137
XP_680493       69   GNSTAVLVSRYP-DARVTGMDSSPDMIGKARET----LPGIEFTVDGLSTYTPRE------PVDLFFSNAVFQWLPR---DQR   137
EYE90700        47   GKFTANFLPAVG----SVLGIDSSPAMIESAKKD-YGNEKAEWRVVDCRYLDKEEAIVNGSWDKVISNAALHWILRDSSTR    122

EHA22176        116  LPTIRRLLLTLPPGGVFAFQVPD--TLNEPSHTSMREVARTGPWAEHLRSTLVERDELESPGEIY--DALVDCCESLRIW   191
XP_001397953    138  LPTIRRLLLALPPGGVFAFQVPD--TLNEPSHTSMREVARTGPWAEHLRGTLVERDELDSPGEIY--DALVDCCESLRIW   213
CAK46985        138  LPTIRRLLLALPPGGVFAFQVPD--TLNEPSHTSMREVARTGPWAEHLRGTLVERDELDSPGEIY--DALVDCCESLRIW   213
GAA85154        140  LPTIRRLLLTLPPGGVFAFQVPD--TLNLPSHTSMREVARTGPWAEHLRSALVERDELDSPEEIY--DALVDCENLRIW   215
GAT24206        118  LPTIRRLLLTLPPGGVFAFQVPD--TLNLPSHTSMREVARTGPWAEHLRSALVERDELDSPEEIY--DALVDCENLRIW   193
GAQ43382        118  LPTIRRLLLTLPPGGVFAFQVPD--TLNLPSHTSMREVARTGSWAEHLRSTLVERDELDTPEEIY--DALVDCESLRIW   193
XP_001213401    120  IEVVKRLLRTQSPGGVFAFQVPD--NLMEPSHVLMRDVAARGPWAETLTH--VHRDGIQSPQEIY--DELIPLCATVSIF   193
XP_002372575    114  IPVIKGLMETQPSGGVFAFQVPD--NLMEPSHVLMREVASNGPWASTLSN--VGRDTFQSPQEIY--DQLKDLSSEVNIF   187
XP_001817493    150  IPVIKGLMETQPSGGVFAFQVPD--NLMEPSHVLMREVASNGPWASTLSN--VGRDTFQSPQEIY--DQLKDLSSEVNIF   223
XP_015403552    114  IVVIKGLMETQPSGGVFAFQVPD--NLMEPSHVLMREVAINGPWASTLSN--VGRDTFQSPQEIY--DQLKDLSSEVNIF   187
KJK61809        114  ITVIRGLMETQPAGGVFAFQVPD--NLMEPSHVLMREVASNGPWASTLSN--VSRDTFQSPQEIY--DQLKDLSSEVNIF   187
KKK27392        143  ISVMKKLIQSQPSGGVFAFQVPD--NLMEPSHAAMRETAADGPWAKTLST--AARDTFQSPQEIY--DELQPLCSAVNMW   216
KKK18725        143  ISVMKKLIQSQPSGGVFAFQVPD--NLMEPSHAAMRETAADGPWAKTLST--AARDTFQSPQEIY--DELQPLCSAVNMW   216
CEL08721        139  LEVVKRLIRSQPSGGVFAFQVPD--NLTEPSHAAMQETAANGPWAEALST--VGRDTFQSPQEIY--DELKPLCSDVNVW   212
EYE90801        114  IALIKRLMESQPSGGVFAFQVPY--NLTEPSHVLMKEVAADGPWASTLKN--TGRDAFQTPREIY--DQLIPMSSEVHIF   187
```

Fig. 14 (Cont. II)

```
CBF78820        138 LEIIKRLIQSQPSGGVFAFQVPD--NLAEPSHVTMREIAANGPWSSTLQS--VARESFQSPHELY--DELKPLCAEVNIW 211
XP_680493       138 LEIIKRLIQSQPSGGVFAFQVPD--NLAEPSHVTMREIAANGPWSSTLQS--VARESFQSPHELY--DELKPLCAEVNIW 211
EYE90700        123 MDTLRAIHGSLKPGGTFVFEMGGHGNVPEVMTALIYTLVQHGVPAEKAKAA----NPWFFPSEVWMKNALESIGFHVDQM 198

EHA22176        192 ESVYYHS----LGSWGEIVEWVKGTGLRPYLDGLRGEEERGEFLKVYEEKLREKYEKR---------------ADGRVLLR- 253
XP_001397953    214 ESVYYHS----LGSWGEIVEWVKGTGLRPYLDGLRGEEERGEFLKVYEEKLREKYEKR---------------ADGRVLLR- 275
CAK46985        214 ESVYYHS----LGSWGEIVEWVKGTGLRPYLDGLRGEEERGEFLKVYEEKLREKYEKR---------------ADGRCIGRG 276
GAA85154        216 ETVYYHS----LGDWRDIVEWVKGTGLRPYLDGLRGEEERKEFLRVYEGLLRERYEKR---------------ADGRVMLR- 277
GAT24206        194 ETVYYHS----LGDWRDIVEWVKGTGLRPYLDGLRGEEERKEFLRVYEGLLRERYEKR---------------ADGRVMLR- 255
GAQ43382        194 ETVYYHS----LGDWRDIVEWVKGTGLRPYLDGLRGEEERNEFLRVYEGLLKERYEKR---------------ADGRVMLR- 255
XP_001213401    194 HTHYYHS----LENHEAIVEWLKGTGLRPYVDPL-GPAEKKAFIAEYLKRLEGAYPRS---------------VDGRVLLR- 254
XP_002372575    188 RTAYHHS----LENHSAIVEWVKGTGLRPYVDPL-SPQDKEAFLSEYLKRLESAYPKL---------------IDGRVLLP- 248
XP_001817493    224 RTAYHHS----LENHSAIVEWVKGTGLRPYVDPL-SPQDKEAFLSEYLKRLESAYPKL---------------IDGRVLLP- 284
XP_015403552    188 RTEYYHS----LEDHKAIVEWVKGTGLRPYVDPL-SLQDKEAFLSDYLKRLESAYPKL---------------IDGRVLLP- 248
KJK61809        188 RTAYYHS----LENHRAIVEWVKGTGLRPYVDPL-SPQDKEAFLSQYLKRLESAYPNL---------------IDGRVLLP- 248
KKK27392        217 HTHYYHS----LEGHEAVMEWVKGTGLRPFIDPL-SPADRDAFLKDYLSRLEKLYPKS---------------VDGRVLLR- 277
KKK18725        217 HTHYYHS----LEGHEAVMEWVKGTGLRPFIDPL-SPADRDAFLKDYLSRLEKLYPKS---------------VDGRVLLR- 277
CEL08721        213 HTHYYHS----LENHEAVVEWVKGTGLRPYIDPL-SATDRESFLEAYLGRLEKLYPKT---------------IDGRVLLR- 273
EYE90801        188 KTDYHHP----LEDHRAIIEWVQGTGLRPYLDPL-SPEEKEAFINEYLKRLESVYPKS---------------VDGRVLLG- 248
CBF78820        212 HTYYNHS----LENHKAVVEWVKGTGLRPFIDPL-SQPDRESFLKAYLGRLEQLYPNSRLQPFGSWQEQLCHTASPAHYP- 286
XP_680493       212 HTYYNHS----LENHKAVVEWVKGTGLRPFIDPL-SQPDRESFLKAYLGRLEQLYPNSRLQPFGSWQEQLCHTASPAHYP- 286
EYE90700        199 EIEFRPTKLTADANGGLAGWIKLMGA-PFLDVL-PGEKQDDAVKQICDILEPVVTREE---------------DGSQWLG- 261

EHA22176        254 ---------------YPRLFAVAVRK--------------------------------------------- 264
XP_001397953    276 ---------------YPRLFAVAVRK--------------------------------------------- 286
CAK46985        277 QNVGCSDHVIQASGVYGMHACWYNPKFIVRIWNRSSGPFSPEISPALDHSPDAIKIEC------------- 334
GAA85154        278 ---------------YPRLFVVAVRK--------------------------------------------- 288
GAT24206        256 ---------------YPRLFVVAVRK--------------------------------------------- 266
GAQ43382        256 ---------------YPRLFVVAVRK--------------------------------------------- 266
XP_001213401    255 ---------------FPRLFVVAVRK--------------------------------------------- 265
XP_002372575    249 ---------------YPRLFVVAVRK--------------------------------------------- 259
XP_001817493    285 ---------------YPRLFVVAVRK--------------------------------------------- 295
XP_015403552    249 ---------------YPRLFVVAVRK--------------------------------------------- 259
KJK61809        249 ---------------YPRLFVVAVRK--------------------------------------------- 259
KKK27392        278 ---------------YPRLFVVAVRE--------------------------------------------- 288
KKK18725        278 ---------------YPRLFVVAVRE--------------------------------------------- 288
CEL08721        274 ---------------YPRLFVVAVRA--------------------------------------------- 284
EYE90801        249 ---------------YPRLFVVAVKK--------------------------------------------- 259
CBF78820        287 ----------------PPALVLVAVLHIVH----IAEIPTLFNVSILALPLRRPWFEISLPLQQSLS----- 333
XP_680493       287 ----------------PPALVLVAVLHIVH----IAEIPTLFNVSILALPLRRPWFEISLPLQQSLSVCLTMLPW 341
EYE90700        262 ----------------YVRLRGISKKI-------------------------------------------- 272
```

Fig. 14 (Cont. III)

```
EHA22176            ----------------------------------------------------------------------------------
XP_001397953        ----------------------------------------------------------------------------------
CAK46985            ----------------------------------------------------------------------------------
GAA85154            ----------------------------------------------------------------------------------
GAT24206            ----------------------------------------------------------------------------------
GAQ43382            ----------------------------------------------------------------------------------
XP_001213401        ----------------------------------------------------------------------------------
XP_002372575        ----------------------------------------------------------------------------------
XP_001817493        ----------------------------------------------------------------------------------
XP_015403552        ----------------------------------------------------------------------------------
KJK61809            ----------------------------------------------------------------------------------
KKK27392            ----------------------------------------------------------------------------------
KKK18725            ----------------------------------------------------------------------------------
CEL08721            ----------------------------------------------------------------------------------
EYE90801            ----------------------------------------------------------------------------------
CBF78820            ----------------------------------------------------------------------------------
XP_680493     342   VEPHLAQSVNPDKGRQLQAAQSIQRGEVLLIDPPYAIIPISDVDATTSLRKAICSNPQCNKPVSRDTASRCPNRCNNDVF  421
EYE90700            ----------------------------------------------------------------------------------

EHA22176            ----------------------------------------------------------------------------------
XP_001397953        ----------------------------------------------------------------------------------
CAK46985            ----------------------------------------------------------------------------------
GAA85154            ----------------------------------------------------------------------------------
GAT24206            ----------------------------------------------------------------------------------
GAQ43382            ----------------------------------------------------------------------------------
XP_001213401        ----------------------------------------------------------------------------------
XP_002372575        ----------------------------------------------------------------------------------
XP_001817493        ----------------------------------------------------------------------------------
XP_015403552        ----------------------------------------------------------------------------------
KJK61809            ----------------------------------------------------------------------------------
KKK27392            ----------------------------------------------------------------------------------
KKK18725            ----------------------------------------------------------------------------------
CEL08721            ----------------------------------------------------------------------------------
EYE90801            ----------------------------------------------------------------------------------
CBF78820            ----------------------------------------------------------------------------------
XP_680493     422   WCNDSCEETDKARHDFECTWLAKYTTSLLSKWGEYNFGMLWLIVRILSRRYTESSYPHNIEDKPPAHDSHPSLSRFKFGW  501
EYE90700            ----------------------------------------------------------------------------------

EHA22176            ----------------------------------------------------------------------------------
XP_001397953        ----------------------------------------------------------------------------------
CAK46985            ----------------------------------------------------------------------------------
GAA85154            ----------------------------------------------------------------------------------
GAT24206            ----------------------------------------------------------------------------------
GAQ43382            ----------------------------------------------------------------------------------
XP_001213401        ----------------------------------------------------------------------------------
XP_002372575        ----------------------------------------------------------------------------------
```

Fig. 14 (Cont. IV)

```
XP_001817493      ------------------------------------------------------------------------------
XP_015403552      ------------------------------------------------------------------------------
KJK61809          ------------------------------------------------------------------------------
KKK27392          ------------------------------------------------------------------------------
KKK18725          ------------------------------------------------------------------------------
CEL08721          ------------------------------------------------------------------------------
EYE90801          ------------------------------------------------------------------------------
CBF78820          ------------------------------------------------------------------------------
XP_680493     502 PAIDSLCGTPETWSHAQVREWTVLVKKYLGSSTLPHDLSNSDVLALICKEEANSFGLYPRETGVFPPPNPPVSRGEQFAA 581
EYE90700          ------------------------------------------------------------------------------

EHA22176          ------------------------------------------------------------------------------
XP_001397953      ------------------------------------------------------------------------------
CAK46985          ------------------------------------------------------------------------------
GAA85154          ------------------------------------------------------------------------------
GAT24206          ------------------------------------------------------------------------------
GAQ43382          ------------------------------------------------------------------------------
XP_001213401      ------------------------------------------------------------------------------
XP_002372575      ------------------------------------------------------------------------------
XP_001817493      ------------------------------------------------------------------------------
XP_015403552      ------------------------------------------------------------------------------
KJK61809          ------------------------------------------------------------------------------
KKK27392          ------------------------------------------------------------------------------
KKK18725          ------------------------------------------------------------------------------
CEL08721          ------------------------------------------------------------------------------
EYE90801          ------------------------------------------------------------------------------
CBF78820          ------------------------------------------------------------------------------
XP_680493     582 AVYPRASIANHSCCPNIIHKPDKVGRMVFTAGRDIAAGEECCISYFDMTQYVSLQDRRRHLQGLFRFKCGCPRCLEEETA 661
EYE90700          ------------------------------------------------------------------------------

EHA22176          --------------------
XP_001397953      --------------------
CAK46985          --------------------
GAA85154          --------------------
GAT24206          --------------------
GAQ43382          --------------------
XP_001213401      --------------------
XP_002372575      --------------------
XP_001817493      --------------------
XP_015403552      --------------------
KJK61809          --------------------
KKK27392          --------------------
KKK18725          --------------------
CEL08721          --------------------
EYE90801          --------------------
CBF78820          --------------------
XP_680493     662 AADTANETHWDAFPGFA  678
EYE90700
```

Fig. 15A

Blast results for Ustilago maydis trans-aconitate decarboxylase UMAG_05076

An14g01340 & An01g02970

```
ALS30796.1  trans-aconitate decarboxylase 1 [Ustilago maydis] (SEQ ID NO:144)
XP_015407832.1  putative argininosuccinate lyase [Aspergillus nomius NRRL 13137](SEQ ID NO:145)
KOC09706.1  putative argininosuccinate lyase [Aspergillus flavus AF70](SEQ ID NO:146)
XP_661615.1  hypothetical protein AN4011.2 [Aspergillus nidulans FGSC A4]  Gene info linked to XP_661615.1(SEQ ID NO:147)
XP_001827023.1  argininosuccinate lyase [Aspergillus oryzae RIB40]  Gene info linked to XP_001827023.1 (SEQ ID NO:148)
XP_002385014.1  argininosuccinate lyase, putative [Aspergillus flavus NRRL3357]  Gene info linked to XP_002385014.1(SEQ ID NO:149)
XP_001212977.1  hypothetical protein ATEG_03799 [Aspergillus terreus NIH2624]  Gene info linked to XP_001212977.1(SEQ ID NO:150)
GAQ42986.1  argininosuccinate lyase [Aspergillus niger] (SEQ ID NO:151)
XP_001400761.2  argininosuccinate lyase [Aspergillus niger CBS 513.88]  Gene info linked to XP_001400761.2 (SEQ ID NO:152)
GAA87147.1  argininosuccinate lyase [Aspergillus kawachii IFO 4308] (SEQ ID NO:153)
EHA26291.1  hypothetical protein ASPNIDRAFT_52023 [Aspergillus niger ATCC 1015](SEQ ID NO:154)
EYE94407.1  L-Aspartase-like protein [Aspergillus ruber CBS 135680](SEQ ID NO:155)
XP_001388731.1  argininosuccinate lyase [Aspergillus niger CBS 513.88]  Gene info linked to XP_001388731.1Genome view with
mapviewer linked to XP_001388731.1(SEQ ID NO:156)
CEL09037.1  Putative Adenylosuccinate lyase [Aspergillus calidoustus] (SEQ ID NO:157)
CEL11312.1  Putative Adenylosuccinate lyase [Aspergillus calidoustus] (SEQ ID NO:158)
CAK41914.1  unnamed (SEQ ID NO:159)

ALS30796        1    MA[24]MSSMASR[19]TLSDIFGTPQMREIWSDQNRVACYLEIEAALAIVQADLGIIPKNAAHEIVEHCRVQEIDWALY  115
XP_015407832    1    MS     ISAVDSR    IFRNLFGTEEVREIFTDEAYAKFLVQTEAALARAESKVNAIPAEVGDAITAALGNIELDFERL   72
KOC09706        1    MS     ISALDSR    IFRNLFGTEEVREIPTDEAYAKFLVQTEAALARAESKVNAIPADVGDAITAVLGNIELDFDRL   72
XP_661615       1    MA[27]VSAIDSS    IFRTLFGTEEIRKVFDDESYIARCVEAEAALARAQSKCNVIPSHIGSLVTDKALSSSLDMDRL   99
XP_001827023    1    MS     ISALDSR    IFRNLFGTEEVREIFTDEAYAKFLVQTEAALARAESKVNAIPADVGDAITSVLGNIELDFDRL   72
XP_002385014    1    MS     ISALDSR    IFRNLFGTEEVREIPTDEAYAKFLVQTEAALARAESKVNAIPADVGDAITAVLGNIELDFDRL   72
XP_001212977    1    MS[26]VSAIDSS    IFRTLFGTEEIRKVFDDEAYINRCIDAEAALARAQSRCNVIPPQVGEMVTQKAIHSKLDLDRL   98
GAQ42986        1    ML     NSAVDSR    IFRNLFGTEEIRDIFADEAYIKCLVEVEIALARAEAKVNVIPHESANVIAENAKYENLDLDRM   72
XP_001400761    1    ML     NSAVDSR    IFRNLFGTEEIRDIFSDEAYIKCLIEVEIALARAEATFNVIPQESADVIAEKAKYENLNLSRM   72
GAA87147        1    ML     NSAVDSR    IFRNLFGTEEIRDIFSDEAYIKCLVEVEIALARAEAKVNVIPHESANVIAENAKYENLDLDRM   72
EHA26291        1    MS[28]VSAIDSG    IFRTLFGTEEIRKVFDDEAYIKRCMDAEAALARAQSRCDVIPSQIGEMVTRKLRESKLDMERL  100
EYE94407        1    MS     ISAFDSR    IFRNLFGTEEIRSIPTDEAYTQYLVQTEAALARAESTIGAIPQDAGAAITAALDTVRLDFERL   72
XP_001388731    1    MS[28]VSAIDSG    IFRTLFGTEEIRKVFDDEAYIKRCMDAEAALARAQSRCDVIPSQIGEMVTRKLRESKLDMERL  100
CEL09037        1    MS[25]VSAIDSS    IFRTLFGTEEIRKVPNDESYISRCIDAEAALARAQSTCGVIPSHIGSLVTTKVTSTPLDMERL   97
CEL11312        1    MV     VSALDSR    VFRNLFGTAEVREIFTDDAYVGFLVEVEAALARAEAAVGVIPADAGTAITDAFKSISLDFDLL   72
CAK41914        1    ML     NSAVDSR    IFRNLFGTEEIRDIFSDEAYIKCLIEVEIALARAEATFNVIPQESADVIAEKAKYENLNLSRM   72

ALS30796       116    KQKTELIGYPVLGIVQQLVANCKDGLGEYCHWGATTQDITDTATVMQIRQSLTLVKQRLDSIVSSLEHLAEQHRNVPMAA  195
XP_015407832    73    SRETEIVGYPVLPLVMQLVENTPEELAKYIHWGATTQDVMDNASMLQIKRGLDLVKRDLNRLIESLQVMAQKYRDTPMAG  152
KOC09706        73    SRETEIVGYPVLPLVMQLVENTPEDLAKYIHWGATTQDVMDNASMLQIKRGLDLVKRDLNKLIDILQVMAEKYRDTPMAG  152
XP_661615      100    RKETEIVGYPILPLVRQLSAMCGEDAGKYVHWGATTQDIMDLASVLQMKQGLGIVEKLLDDVIAVLRGLSVKYRDAPMAG  179
XP_001827023    73    SRETEIVGYPVLPLVMQLVENTPEDLAKYIHWGATTQDVMDNASMLQIKRGLDLVKRDLNKLIDILQVMAEKYRDTPMAG  152
XP_002385014    73    SRETETVGYPVLPLVMQLVENTPEDLAKYIHWGATTQDVMDNASMLQIKRGLDLVKRDLNKLIDILQVMAEKYRDTPMAG  152
XP_001212977    99    RRETEIVGYPILPLVRQLSAMCGEEAGRYVHWGATTQDIMDLASVLQMKEGLVIVERLLRDIIATLRELSAKYRDTPMAG  178
GAQ42986        73    AADTENVGYPVLPLVWQLAEMVPEEHAKYIHWGATTQDIMDCASMVQMRRGLAIVRRNLHELDATLKSLSEKYADTPMAG  152
XP_001400761    73    AADTENVGYPVLPLVWQLAEMVPQEHAKYIHWGATTQDIMDCASMVQIRRGLVVVRRNLHELDTALRALSEKYADTPMAG  152
GAA87147        73    AADTENVGYPVLPLVWQLAEMVPGEHAKYIHWGATTQDIMDCASMVQMRRGLVIVRRNLHELNATLKSLSEKYADTPMAG  152
EHA26291       101    RYETEIVGYPILPLVRQLSAICGGDEAGKYVHWGATTQDIMDLASVLQMKEGLDIVEHHLKKVISTLRGLSVKYDTPMAG  180
EYE94407        73    SQETEVVGYPVLPLVEHTPEAMGKYIHWGATTQDIMDVASILQMKEGLKLVERELDTLIGILTLSLSGKHRDTPMAG     152
XP_001388731   101    RYETEIVGYPILPLVRQLSAICGDEAGKYVHWGATTQDIMDLASVLQMKEGLDIVEHHLKKVISTLRGLSVKYDTPMAG   180
CEL09037        98    RTETEIVGYPILPLVRQLSAMCGSEAGKYVHWGATTQDIMDLASILQMKRGLEIVERLVGEIIGVLRGLSVRYRDTPMAG  177
CEL11312        73    ARETDIVGYPVLPLVKQLVNGTPGEMSKYIHWGATTQDIMDDASVLQMKRGLQLVRRELQTLAGTLQGLAQKYRDTPMAG  152
CAK41914        73    AADTENVGYPVLPLVWQLAEMVPQEHAKYIHWGATTQDIMDCASMVQIRRGLVVVRRNLHELDTALRALSEKYADTPMAG  152
```

Fig. 15A (Cont. I)

```
ALS30796        196  RSNLKQAVPITFGFKMARFLATFRRHQQRLVELEKRVYTLEFGGAAGNLSSLG--DQGIATHDALAKMLDLAPAEIAWHT  273
XP_015407832    153  RTHLQHALPCTFGYKCAVYLSSILRHRDRLCEIERRCLLVQFGGAAGTLASLGSDRSGILVRAQLAKELDLEDPMITWHV  232
KOC09706        153  RTHLQHALPCTFGYKCAVYLSSILGHRDRLCQIERRCLLVQFGGAAGTLASLGSDRTGILVRAQLAKELELEDPMITWHV  232
XP_661615       180  RTHLQHALPVTFGYKCAVWLSGFQRHAQRLKQLRERTLFVQFGGAAGSLASLGSGDDGLRVRKALADELGLTNPPITWHV  259
XP_001827023    153  RTHLQHALPCTFGYKCAVYLSSILRHRDRLRQIERRCLLVQFGGAAGTLASLGSDRTGILVRAQLAKELELEDPMITWHV  232
XP_002385014    153  RTHLQHALPCTFGYKCAVYLSSILRHRDRLCQIERRCLLVQFGGAAGTLASLGSDRTGILVRAQLAKELELEDPMITWHV  232
XP_001212977    179  RTHLQHALPVTFGYKCAVWLSGFQRELERLEQLRSRTLLVQFGGAAGSLASLGDGDDGLRVRRALAEELGLADPPITWHV  258
GAQ42986        153  RTHLQHALPITFGYKCAVYLSGIQRHIQRLTEIERRCLLVQFGGAAGTLASLGSDDTGLKVRKQLATELGLHDPSITWHV  232
XP_001400761    153  RTHLQHALPITFGYKCAVYLSGIQRHIQRLAEIELRCLLVQFGGAAGTLASLGSDNTGLQVRKQLARELGLHDPSITWHV  232
GAA87147        153  RTHLQHALPITFGYKCAVYLSGLQRHIQRLTEIEHRCLLVQFGGAAGTLASLGSDDTGLEVRKQLATELGLHDPSITWHV  232
EHA26291        181  RTHLQHALPVTFGYKCAVWLSGFQRQLERLEQLKERCLLVQFGGAAGSLASLGTGDDGLRVRKALAEELGLTDPPITWHV  260
EYE94407        153  RTHLQHALPCTFGYKCAVYLSSILRHKDRLQQLRERCLLVQFGGAAGTLASLGTDDIGLRVRAQLAKELGLENPMITWHV  232
XP_001388731    181  RTHLQHALPVTFGYKCAVWLSGFQRHELERLEQLKDRCLLVQFGGAAGSMASLGTGDDGLRVRKALAEELGLTDPPITWHV  260
CEL09037        178  RTHLQHALPVTFGYKCAVWLSGFQRHAARLKEMRERVLMVQFGGAAGSLASLGDGDDGIRVRKALAEELGLSDPPITWHV  257
CEL11312        153  RTHLQHALPCTFGYKCAVYLSSILRHQERLEEIERRCLLVQFGGAAGTLASLQDPDTGLKVRAELAKELGLRDPLITWHV  232
CAK41914        153  RTHLQHALPITFGYKCAVYLSGIQRHIQRLAEIELRCLLVQFGGAAGTLASLGSDNTGLQVRKQLARELGLHDPSITWHV  232

ALS30796        274  EHDRPAEVGTFLGLLTGTLAKLATDIKLMSQTEVGEVGEPFISNRGSSSTMPQKNNPISCVYIHACAANVRQGAAALLDA  353
XP_015407832    233  ARDNIAEVLNFLALVGGTLGKIALDIIVMSSNELDEVAEPFVPHRGASSTMPQKRNPISSEIILATSKLLRANASLGLDA  312
KOC09706        233  ARDNIAEVLNFLALIGGTLGKIALDIIVMSSNELDEVAEPFVPHRGASSTMPQKRNPISSEIILATSKLLRANASLGLDA  312
XP_661615       260  ARDGVAEITNFLALLGGSLGKLALDVIIMSSNELGEVSEPFVPHRGASSTMPQKRNPISSEVILAASKRLRSNASLVLDG  339
XP_001827023    233  ARDNIAEVLNFLALIGGTLGKIALDIIVMSSNELDEVAEPFVPHRGASSTMPQKRNPISSEIILATSKLLRANASLGLDA  312
XP_002385014    233  ARDNIAEVLNFLALIGGTLGKIALDIIVMSSNELDEVAEPFVPHRGASSTMPQKRNPISSEIILATSKLLRANASLGLDA  312
XP_001212977    259  ARDGVAEIANFLALMGGSMGKLALDIIVMSSNELGEVSEPFVPHRGASSTMPQKRNPISSEVILAASKVLRSNAGLVLDG  338
GAQ42986        233  ARDHIAEIINFLALIGGSLGKIALDIIIMSSNEVAEVAEPFVPFRGASSTMPQKRNPISSEAILASSKLLRSNASLALDA  312
XP_001400761    233  ARDHVAEVVNFLALVGGSLGKIALDIIIMSSNEVAEVAEPFVPFRGASSTMPQKRNPISSEVILASSSKLLRSNASLALDA  312
GAA87147        233  ARDHIAEIINFLALIGGSLGKIALDIIIMSSNEVAEVAEPFVPFRGASSTMPQKRNPISSEVILASSKLLRSNASLALDA  312
EHA26291        261  ARDGIAEITNFLALMGGSMGKLALDIIIMSSNELGEVSEPFVPHRGASSTMPQKRNPISSEVILAASKILRSNAGLVLDG  340
EYE94407        233  ARDNIGEILGYLALVGGTLGKIALDLIIMSSNEMDEVSEPFVPHRGASSTMPQKRNPISSEVILAASKLLRSHASLGLDA  312
XP_001388731    261  ARDGIAEITNFLALMGGSMGKLALDIIIMSSNELGEVSEPFVPHRGASSTMPQKRNPISSEVILAASKILRSNAGLVLDG  340
CEL09037        258  ARDGVAEVTNYLALLGGSMGKLALDIIIMSSNELGEVSEPFVPHRGASSTMPQKRNPISSEVILAASKVLRSNAGLVLDG  337
CEL11312        233  ARDTIAEILNFLALIGGTLGKIALDLIVMSSNEFDEVSEPFVPHRGASSTMPQKRNPISSEVILAASKLLRSNASLGLDA  312
CAK41914        233  ARDHVAEVVNFLALVGGSLGKIALDIIIMSSNEVAEVAEPFVPFRGASSTMPQKRNPISSEVILASSKLLRSNASLALDA  312

ALS30796        354  MQSDHERGTGPWEIIWVQLPLMMNWTSAALNNADFVLRGLQVFPDAMQEHNLDLSKGLIVSEAVMMGLGNTLGRQYAHDAV  433
```

Fig. 15A (Cont. II)

```
XP_015407832  313  MVVDFERASGPWHLEWVAIPESFTYAVGALHQTTFALSGLCVKEDSMEKNLHSTRGLIVGEAVMMGLAPFVGRQRAHDVV  392
KOC09706      313  MVVDFERASGPWHLEWVAIPESFTYVVGALHQTTFALSGLCVKEDSMEKNLHSTRGLIVGEAVMMGLAPFVGRQRAHDVV  392
XP_661615     340  MVADFERASGPWHLEWVAIPESFVLAVGALEQTKFALGGLVVHEQAMLKNLHSTKGLIVAEAVMMGLAPFVGRQRAHDIV  419
XP_001827023  313  MVVDFERASGPWHLEWVAIPESFTYAVGALYQTTFALSGLCVKEESMEKNLHSTRGLIVGEAVMMGLAPFVGRQRAHDVV  392
XP_002385014  313  MVVDFERASGPWHLEWVAIPESFTYAVGALYQTTFALSGLCVKEESMEKNLHSTRGLIVGEAVMMGLAPFVGRQRAHDVV  392
XP_001212977  339  MVADFERASGPWHLEWVAVPESFVIAVGALSQTHFALSGLCVHSKQMLDNLHSTKGLIVAEAVMMGLAPHVGRNKAHDIV  418
GAQ42986      313  MVSDFERASGPWHLEWSCVPDSFVLCCGALHQANFIMKGLLVNTEAMSDNLNMTKGLIVAEAVMMGTAPKLGRQRAHDVV  392
XP_001400761  313  MVSDFERASGPWHLEWSCIPDSFVLCCGALHQANFIMRGLLVNTDVMSSNLNMTKGLIVAEAVMMGTAPKIGRQRAHDVV  392
GAA87147      313  MVSDFERASGPWHLEWSCVPDSFVLCCGALHQANFVIKGLLVNTEAMSNNLNMTKGLIVAEAVMMGTAPKLGRQRAHDVA  392
EHA26291      341  MVADFERASGPWHLEWVAIPESFVIAVGALSQTQFALSGLCVHGQKMLENLHSTKGLIVAEAVMMGLAPHVGRQQAHDIV  420
EYE94407      313  MVVDFERASGPWHLEWAAIPEAFTVAVGALYQTKFALGGLVVKEASMMKNLLCTRGLIVGEAVMMNLGEYIGRQQAHDVV  392
XP_001388731  341  MVADFERASGPWHLEWVAIPESFVIAVGALSQTQFALSGLCVHSQKMLENLHSTKGLIVAEAVMMGLAPHVGRQQAHDTV  420
CEL09037      338  MVADFERASGPWHLEWVAVPESFVIAVGALEQTKFALGGLCVHSEAMLRNLHSTKGLIVAEAVMMGLAPAVGRQRAHDIV  417
CEL11312      313  MVTDFERASGPWHLEWVAIPEAFITAVGALHQTNFALGGLVVKVDSMSRNLHSTRGLIVGEAVMMGLAPVLGRQKAHDVV  392
CAK41914      313  MVSDFERASGPWHLEWSCIPDSFVLCCGALHQANFIMRGLLVNTDVMSSNLNMTKGLIVAEAVMMGTAPKIGRQRAHDVV  392

ALS30796      434  YECCRTAFVQDRPLLDVLLENHEIASKLDRTELEKLCDPANYLGQCSQWIDRVLSRP[ 3]  493
XP_015407832  393  YEACKSAIEHDRVLLDVLKENKEVSEHLNETKLAQLCDPLNYLGSGQLMVDDVLRRV[ 6]  455
KOC09706      393  YEACKSAIEHDRVLLDVLKENTEVSYHLNEAKLTQLCDPLNYLGSGQLMVDDVLKRV[10]  459
XP_661615     420  YEACQGTIESGGSLEEELLKNQEVLEKMGKDRISELCDPVNYLGSCGRMVDDVLAVD      476
XP_001827023  393  YEACKSAIEHDRVLLDVLKENTEVSEHFNEAKLTQLCDPLSYLGSGQLMVDDVLKRV[10]  459
XP_002385014  393  YEACKSAIEHDRVLLDVLKENTEVSEHFNEAKLTQLCDPLSYLGSGQLMVDDVLKRV[10]  459
XP_001212977  419  YEACRESIEKDRTLLECLLEKPEVTSKMSTEEVSKLCDPVNYLGASGRMVDDVLAVD      475
GAQ42986      393  YEACTKAIEGNLPLIDVLQQDNSLVAEVGVERLRSLCDPCQYLGCCRQMIENVIRDE      449
XP_001400761  393  YEACTKAIEGNLPLIDILRQDESLVAQVGEEKLRSLCDPCQYLGCCRQMIENVIQYE      449
GAA87147      393  YEACTKAIEGNLPLIDVLQQDNSLVAEVGVERLRSLCDPCQYLGCCRQMIENVIHDE      449
EHA26291      421  YEACRESIEANQSLLECLMKKTEVTSKMSEERLSQLCDPVNYLGASTRMVEDVLAVD      477
EYE94407      393  YNACNAAIEEDRALLDVLKEDSCVVEQLGEDKLAQLCDPLNYLGSCQLMVDRVVNEA[10]  459
XP_001388731  421  YEACRESIEANQSLLECLMKKTEVTSKMSEERLSQLYDPVNYLGASTRMVEDVLAVD      477
CEL09037      418  YEACRESIESGGSLEEALLGKTEVTEKMSVERVRQLCDPVNYLGASGRMVDDVLAVD      474
CEL11312      393  YEACKTAIEGNRSLLEVLQENSELSKTLPADQLASLCDPLQYLGASQRMVDAVVGAL[ 1]  450
CAK41914      393  YEACTKAIEGNLPLIDILRQDESLVAQVGEEKLRSLCDPW------VRSGVKDVTDYG     444
```

Fig. 15B

Blast results for Ustilago maydis aconitate isomerase UMAG_11778

An13g01480, An02g11060, An12g05470, An18g00050

```
(SEQ ID NO:160)ALS30798         1  -----------  -  ---------MLHPIDTTIYRAGTSRGLYFLASDLPAEPSERDAALISIMGSGHPL---QI  48
(SEQ ID NO:161)XP_001396287     1  [ 4]RiMLRQLRHT[5]R  ---SLSTKKQHHLPAAYYRGGTSRAIFFKQDDLPADKAKWDPIFRGVLGSPDPYGRQL  75
(SEQ ID NO:162)CAK41548          1  --MLRQLRHT[5]R  ---SLSTKKQHHLPAAYYRGGTSRAIFFKQDDLPADKAKWDPIFRGVLGSPDPYGRQL  69
(SEQ ID NO:163)KJJ34496          1  -----------  -  -------MKKQRSLPAAYYRGGTSRAVFFRQEDLPRDRKSWDPIFLDVIGSPDPYGRQL  52
(SEQ ID NO:164)XP_001819141     1  -----------  -  -------MKKQRSLPAAYYRGGTSRAVFFRQEDLPRDRKSWDPIFLDVIGSPDPYGRQL  52
(SEQ ID NO:165)EHA27337          1  [ 4]RiMLRPLRHT[5]R  ---SLSTKKQHHLPAAYYRGGTSRAIFFKQDDLPADKAKWDPIFRGVLGSPDPYGRQL  75
(SEQ ID NO:166)EYE99302          1  [ 6]RaSPRGIFST[4]R  ---TLTTKKQHSLPAAYYRGGTSRAVFFKQSDLPHDRAQWDHIFRSVIGSPDPYGRQL  76
(SEQ ID NO:167)CEL09686          1  [ 7]Q-SKLTL----  -[3]RHASS-RASQNSLPAAYYRGGTSRAVFFNQADLPRNRTEWAPIFRGVIGSPDPYGRQL  73
(SEQ ID NO:168)KJK63554          1  -----------  -  -------MKKQRSLPAAYYRGGTSRAVFFRQDDLPRDRKSWDPIFLDVIGSPDPYGRQL  52
(SEQ ID NO:169)GAO84354          1  -----------  -[1]SGTALLSKKQNSIPAAYYRGGTSRAIFFREEDLPSEQQQWDDIFRGTIGSPDPYGRQL  59
(SEQ ID NO:170)GAQ03913          1  -----------[1]H[4]SSIASLSKKQNSIPAAYYRGGTSRAIFFRKEDLPLERQQWDDIFRGTIGSPDPYGRQL  64
(SEQ ID NO:171)XP_731519        1  [ 8]WlLHPSPLRS[5]H[4]SSTAPFSKKQNSIPAAYYRGGTSRAIFFRKEDLPSEQQQWDDIFRGTIGSPDPYGRQL  86
(SEQ ID NO:172)KMK55456          1  [ 5]----------  -[1]STTQPES--------AYYRGGTSRAIFFRKEDLPSEQQQWDDIFRGTIGSPDPYGRQL  56
(SEQ ID NO:173)EDP47862          1  [ 8]WlLHPSPLRS[5]H[4]SSTAPLSKKQNSIPAAYYRGGTSRAIFFRKEDLPSEQQQWDDIFRGTIGSPDPYGRQL  86
(SEQ ID NO:174)KEY81347          1  [ 7]RlLHPSPLRS[5]H[4]SSTAPLSKKQNSIPAAYYRGGTSRAVFFRKEDLPSEQQQWDDIFRGTIGSPDPYGRQL  85
(SEQ ID NO:175)XP_001400235     1  [ 6]R--NRVASSA  -  ---RRYLSKQHSIPAAYYRGGTSRAVMFNQAHLP-PRSEWDAIFRSVIGSPDPYGRQL  68
(SEQ ID NO:176)GAA84478          1  [ 6]R--NQVAFSA  -  ---RRYLSKQHSLPAAYYRGGTSRAVMFNQAHLP-PRSEWDAIFRSVIGSPDPYGRQL  68
(SEQ ID NO:177)XP_001257313     1  [ 7]RlLHPSKLRN[5]H[4]SSTAPLSKKQNSIPAAYYRGGTSRAIFFRKEDLPSEQQQWDDIFRGTIGSPDPYGRQL  85
(SEQ ID NO:178)EHA23360          1  [ 6]R--NRVASSA  -  ---RRYLSKQHSIPAAYYRGGTSRAVMFNQAHLP-PRSEWDAIFRSVIGSPDPYGRQL  68
(SEQ ID NO:179)GAQ36994          1  [ 6]R--NRAAFSA  -  ---RRYLSKQHSLPAAYYRGGTSRAVMFNQAHLP-PRSEWDAIFRSVIGSPDPYGRQL  68
(SEQ ID NO:180)XP_001270418     1  [ 7]QaMRSSA--A[5]H[4]SGAWLYVKKQHSLPAAYYRGGTSRAIFFRREDLPRDQTQWDGIFRGSIGSPDPYGRQL  83
(SEQ ID NO:181)XP_015412475     1  [ 8]RpLIQSLLSS[1]-  AHLSTHTKPQKSLPAAYYRGGTSRAVIFKTEDLPTDRSAWDEIFRRVIGSPDPNGRQL  77
(SEQ ID NO:182)XP_662991        1  [ 7]RcQRPRL---  -[3]RQLSSFRISQSSLPAAYYRGGTSRAVFFNQDDLPKSRDEWAPIFRGVIGSPDPYGRQL  75
(SEQ ID NO:183)XP_001210014     1  [ 8]MiNTTSRGAA[1]-  SSLAHRRAPQRSLPASYYRGGTSRAVFFKQSDLPTDHTSWDEIFRRVIGSPDPNGRQL  77
(SEQ ID NO:184)XP_001820453     1  [ 8]RpLTQTLLPN[1]-  ANLSTRTKPQKSLPAAYYRGGTSRAVIFKKEDLPTDRSAWDEIFRRVIGSPDPNGRQL  77
(SEQ ID NO:185)XP_002373956     1  [ 8]RpLTQTLLPN[1]-  ANLSTRTKPQKSLPAAYYRGGTSRAVIFKKEDLPTDRSAWDEIFRRVIGSPDPNGRQL  77
(SEQ ID NO:186)KJJ36989          1  [ 8]RpLTQTLLPN[1]-  ANLSTRTKPQKSLPAAYYRGGTSRAVIFKKEDLPTDRSAWDEIFRHVIGSPDPNGRQL  77
(SEQ ID NO:187)EIT81585          1  [ 8]RpLTQTLLPN[1]-  ANLSTRTKPQKSLPAAYYRGGTSRAVIFKKEDLPTDRSAWDEIFRRVIGSPDPNGRQL  77
(SEQ ID NO:188)KJK65623          1  [ 8]RpLTQNFLPN[1]-  ANLSIRTKPQKSLPAAYYRGGTSRAVIFKKEDLPTDRSAWDEIFRRVIGSPDPNGRQL  77
(SEQ ID NO:189)CEN62014          1  [33]KpRNRVDPIW[5]M[3]PVSLQPRPRHHVLPCVLMRAGTSKGIFLHRRDLPLDKLDWAPHLISALGSRGNDPRQI  110
(SEQ ID NO:190)XP_002376737     1  -----------     M[3]LVTETRRLRRHALPCVLMRAGTSKGIFLHQKDLPTKEADWAPHLISALGSRGNDPRQI  62
(SEQ ID NO:191)EIT75080          1  -----------     M[3]LVTETRRLRRHALPCVLMRAGTSKGIFLHQKDLPTKEADWAPHLISALGSRGNDPRQI  62
(SEQ ID NO:192)XP_001821002     1  -----------     M[3]LVTETRRLRRHALPCVLMRAGTSKGIFLHQKDLPTKEADWAPHLISALGSQGNDPRQI  62
(SEQ ID NO:193)XP_001395615     1  -----------  -  -----MPKSSQYSLPATYYRGGTSKALFFREDVLPDPGPQRDRLLKRAMGSPEPL--QL  52
(SEQ ID NO:194)XP_001398476     1  MtQTYSVTRA[5]L[3]TKYRSNESVRKSLPAVWMRAGTSKGLFLHRRHLPASKTLWEPILLSAMGSSKGSSRQI  77
(SEQ ID NO:195)KOC09026          1  [790]PmAKTPIAVH[5]M[3]LVTETRRLRRHALPCVLMRAGTSKGIFLHQKDLPTKEADWAPHLISALGSRGNDPRQI  867
(SEQ ID NO:196)CAK46258          1  -----------  -  -----MPKSSQYSLPATYYRGGTSKALFFREDVLPDPGPQRDRLLKRAMGSPEPL--QL  52
(SEQ ID NO:197)XP_015408091     1  [834]KtLMLPVLAR[5]M[3]LVTKTRRLKRHALPCVLMRAGTSKGIFLHQKDLPMKEVDWAPHLVSALGSRGNDPRQI  911
(SEQ ID NO:198)EHA18754          1  MtQTYSVTRA[5]L[3]TKYRSNESVRKSLPAVWMRAGTSKGLFLHRRHLPASKTLWEPILLSAMGSSKGSSRQI  77
(SEQ ID NO:199)GAO81732          1  MsPAYAISPV[5]K[2]-KYAPPSS-RKTLPAVWMRSGTSKGLFLHRRHLPASTHLWEPILLSAMGSSQGDGRQI  74
(SEQ ID NO:200)CAK43083          1  MtQTYSVTRA[5]L[3]TKYRSNESVRKSLPAVWMRAGTSKGLFLHRRHLPASKTLWEPILLSAMGSSKGSSRQI  77
(SEQ ID NO:201)EYE98603          1  MtQTYSISRA[5]L[3]-KYTPEVPVRKSLPAVWMRAGTSKGLFFHRHLPASAAHWEPILLSAMGSTKESSRQI  76
(SEQ ID NO:202)GAA92128          1  -----------  -  -------------------------------------MGSSTGSSRQI  11
(SEQ ID NO:203)XP_015409321
(SEQ ID NO:204)GAQ46340          1  -----------  -  -------------------------------------MGSSTGRSRQI  11
(SEQ ID NO:205)XP_015407774     1  -----------[3]I[3]VVSHASNSARTGIPEVWMRAGTSKGLFIHEHDLPSSKDLWAPILLSALGLAEADKRQL  65
(SEQ ID NO:206)XP_001210444     1  MsQTYSITQT[5]V[3]-QWTQKASVRKSIPAVWMRAGTSKGLFIHRRHHLPPSPADWEPILLSAMGSTKEGSRQI  76
(SEQ ID NO:207)KOC12936          1  -----------[3]I[3]AVSHTSNPVRTGIPAVWMRAGTSKGLFIHEHDLPWSKDLWAPILLSALGSAEGGKRQL  65
(SEQ ID NO:208)XP_003190455     1  -----------[3]I[3]AVSHASNPVRTGIPAVWMRAGTSKGLFIHEHDLPWVKDLWAPILLSALGSAEGGKRQL  65
(SEQ ID NO:209)XP_002381418     1  -----------[3]I[3]AVSHASNPVRTGIPAVWMRAGTSKGLFIHEHDLPWSKDLWAPILLSALGSAEGGKRQL  65
(SEQ ID NO:210)KJK68742          1  -----------  -  -----------------MRAGTSKGLFIHEHYLRSSKDLWAPILLSTLGSAEADKRQL  41
```

Fig. 15B (Cont. I)

```
ALS30798        49   DGMGGGNSLTSKVAIVSASTQrSEFDVDYLFCQVGITERPVDTAPNCGNLMSGVAAFAIERGL[ 2]-PHPSDT--TCLV   123
XP_001396287    76   DGLGGGISSLSKICVVGKPTH-PSADIDYTFVSLGVKTPDVDYSSNCGNMISAVGPFAVDSGL   VV--PGL-TSASV   147
CAK41548        70   DGLGGGISSLSKICVVGKPTH-PSADIDYTFVSLGVKTPDVDYSSNCGNMISAVGPFAVDSGL   VV--PGL-TSASV   141
KJJ34496        53   DGLGGGISSLSKICIVGKSQH-PEADVDYTFVSLGVKTPDVDYSSNCGNMISAVGPFAVDSKL   VQVSSNA-TDASI   126
XP_001819141    53   DGLGGGISSLSKICIVGKSQH-PEADVDYTFVSLGVKTPDVDYSSNCGNMISAVGPFAVDSKL   VQVSSNA-TDASI   126
EHA27337        76   DGLGGGISSLSKICVVGKPTH-PGADIDYTFVSLGVKTPDVDYSSNCGNMISAVGPFAVDSGL   VL--PGL-TSASV   147
EYE99302        77   DGMGGGISSLSKVCVVGKSTH-PNADVDYTFIALGVYTPEVDYSSNCGNMISAVGPYAVDAGL[ 2]TT--GGS-NSVAV   150
CEL09686        74   DGLGGGISSLSKVCVVGAATH-PAADVDYTFAALGVKNDEVDFSSNCGNMVSAVGPYAVDAGL   FDVHGEA-ESAVV   147
KJK63554        53   DGLGGGISSLSKICIVGKSQH-PEADVDYTFVSLGVKTPDVDYSSNCGNMISAVGPFAVDSKL   VQVSSDT-TDVSV   126
GAO84354        60   DGMGGGISSLSKVCVVGKSDR-PDADVDYTFVSLGVKNTDVDYSSNCGNMISAVGPYAVDTGL   FPVADDA-NAVSV   133
GAQ03913        65   DGMGGGISSLSKVCVVSKDR-PDADVEYTFVSLGVKNMDVDYSSNCGNMISAVGPYAVDAGL   FSVAGDAnDVVSV   139
XP_731519       87   DGMGGGISSLSKVCVVSKDR-PDADVEYTFVSLGVKNMDVDYSSNCGNMISAVGPYAVDTGL   FPVADDA-DVVSV   160
KMK55456        57   DGMGGGISSLSKVCVVSKDR-PDADVEYTFVSLGVKNMDVDYSSNCGNMISAVGPYAVDTGL   FPVADDA-DVVSV   130
EDP47862        87   DGMGGGISSLSKVCVVSKDR-PDADVEYTFVSLGVKNMDVDYSSNCGNMISAVGPYAVDTGL   FPVADDA-DVVSV   160
KEY81347        86   DGMGGGISSLSKVCVVSKDR-PDADVEYTFVSLGVKNMDVDYSSNCGNMISAVGPYAVDTGL   FPVADDA-DVVSV   159
XP_001400235    69   DGLGGGISSLSKVCVVGKSTH-PDADVDYTFVSLGVKNSDVDYSSNCGNMISAIGPFALDQKL   VS-SQTP-ESATV   141
GAA84478        69   DGLGGGISSLSKVCVVGKSTH-PDADVDYTFVSLGVKNSDVDYSSNCGNMISAIGPFALDQKL   VS-SQTP-ESATV   141
XP_001257313    86   DGMGGGISSLSKVCVVSKDR-PNADVEYTFVSLGVKNMDVDYSSNCGNMISAVGPYAVDTGL   FPVADDA-NVVSV   159
EHA23360        69   DGLGGGISSLSKVCVVGKSTH-PDADVDYTFVSLGVKNSDVDYSSNCGNMISAIGPFALDQKL   VS-SQTP-ESATV   141
GAQ36994        69   DGLGGGISSLSKVCVVGKSTH-PDADVDYTFVSLGVKNSDVDYSSNCGNMISAIGPFALDQKL   VS-SQTP-ESATV   141
XP_001270418    84   DGMGGGISSLSKICVVNKSAR-LDADVDYTFVSLGVKNCDVDYSSNCGNMVSAVGPYAVDTGL   YPVAAKGnDSVSV   158
XP_015412475    78   DGLGGGISSLSKICIVGKSTT-PDVDIDYTFVSLGVKNTHVDYSSNCGNMISAIGPFAVDSGL   FPVSPDGhEDVEL   152
XP_662991       76   DGLGGGISSLSKVCVVGKSAH-PDADVDYTFAALGIRDTDVDFSSNCGNMVSAVGPYAVDSGL   FAAHKDA-ESAVV   149
XP_001210014    78   DGLGGGISSLSKICVVGPSTR-PDADIDYTFVAMGVKDSQVDYSSNCGNMISAVGPYAVDSQL   VPVQPDGhAEADL   152
XP_001820453    78   DGLGGGISSLSKICVVSKTT-PDVDIDYTFVSLGVKNTHVDYSSNCGNMISAIGPFAVDSRL   FPVNSDGyEDVEL   152
XP_002373956    78   DGLGGGISSLSKICVVGKSTT-PDVDIDYTFVSLGVKNTHVDYSSNCGNMISAIGPFAVDSRL   FPVNSDGyEDVEL   152
KJJ36989        78   DGLGGGISSLSKICVVGKSTT-PDVDIDYTFVSLGVKNTHVDYSSNCGNMISAIGPFAVDSRL   FPVNSDGyEDVEL   152
EIT81585        78   DGLGGGISSLSKICVVGKSTT-PDVDIDYTFVSLGVKNTHVDYSSNCGNMISAIGPFAVDSRL   FPVNSDGyEDVEL   152
KJK65623        78   DGLGGGISSLSKICVVGKSTT-PDVDIDYTFVSLGVKNTHVDYSSNCGNMISAIGPFAVDSRL   FPVNSDGyEDVEL   152
CEN62014       111   DGVGGGTSTTSKVAVVSRSER-PDADIDWTFVQVAVGKESIDLTGNCGNMTAGVAPFAVQEGL   VRPQPGQ-TKMDV   184
XP_002376737    63   DGVGGGTSTTSKVAVVRRSQR-PDADVDWTFVQVAVGKESVDPTGTCGNMTAGVAPFAIQEGL   VKPRRDQ-TKMDV   136
EIT75080        63   DGVGGGTSTTSKVAVVRRSQR-PDADVDWTFVQVAVGKESVDFTGTCGNMTAGVAPFAIQEGL   VKPRRDQ-TKMDV   136
XP_001821002    63   DGVGGGTSTTSKVAVVRRSQR-PDADVDWTFVQVAVGKESVDFTGTCGNMTAGVAPFAIQEGL   VKPRRDQ-TKMDV   136
XP_001395615    53   DGMGGSKAVTSKIAIVRPSTR-SDADIDFTAQVGVARDFIHYGANCGNISAAVGPFAIEEGL[ 5]GRSVDTTvKTQEV   132
XP_001398476    78   DGVGGASSTTSKVAIVERSNR-PGVDVEYTFVQVAPDQPRIDVTGNCGNIASGVGPFALDEGL[ 2]IPEG---eKEVNI   151
KOC09026       868   DGVGGGTSTTSKVAVVRRSQR-PDADVDWTFVQVAVGKESVDFTGTCGNMTAGVAPFAIQEGL   VKPRRDQ-TKMDV   941
CAK46258        53   DGMGGSKAVTSKIAIVRPSTR-SDADIDFTAQVGVARDFIHYGANCGNISAAVGPFAIEEGL[ 5]GRSV---------   123
XP_015408091   912   DGVGGGTSTTSKVAVVRRSQR-PDADIDWTFVQVAVGKESVDFTGTCGNMTAGVAPFAIQEGL   IKPQREQ-TKMDV   985
EHA18754        78   DGVGGASSTTSKVAIVERSNR-PGVDVEYTFVQVAPDQPRIDVTGNCGNIASGVGPFALDEGL[ 2]IPEG---eKEVNI   151
GAO81732        75   DGVGGASSTTSKVAVVERSSR-PNVDVEYTFVQVAPDQPRIDMTGNCGNIAAGVGPFALDEGI[ 2]AAPG---qKEIDI   148
CAK43083        78   DGVGGASSTTSKVAIVERSNR-PGVDVEYTFVQVAPDQPRIDVTGNCGNIASGVGPFALDEGL[ 3]VWETRLIePQVNI   155
EYE98603        77   DGVGGASSTTSKVAVVERSSR-PGVDVEYTFVQVAPDQPRVDLTGNCGNIASGVGPFALDEGL[ 2]APDG---kKEIDI   150
GAA92129        12   DGVGGASSTTSKVAIVERSSR-PGVDVEYTFVQVAPDQPRIDMTGNCGNIASGVGPFALDEGL[ 2]VPER---eKEINI    85
XP_015409321     1   ---------------------------------------------MISAVGPFAVDSKL   VQVSSAA-SEASV    26
GAQ46340        12   DGVGGASSTTSKVAIVERSSR-PGVDVEYTFVQVAPDQPRIDMTGNCGNIASGVGPFALDEGL[ 2]VPER---kKEIDI    85
XP_015407774    66   NGVGGATSTTSKVAVVRKSKR-HGVDVDYTFVQVASDQAQVDMTGNCGNMASGVGPFALDEEL[ 4]LTPTHSKsWSKPS   144
XP_001210444    77   NGVGGASSTTSKVAVVERSSR-PGVDVEYTFVQVAPDQPRIDMTGNCGNIASGIGPFALDEGL[ 2]APEG---kKEIDI   150
KOC12936        66   NGVGGATPTTSKVAVIRKSKL-PVVDADYTFVQVAPDQAQVDMTGNCGNMASGVGPFALDEEL[ 3]LAPL--LnWQMDI   141
XP_003190455    66   NGVGGATPTTSKVAVIRKSKI-PVVDADYTFVQVAPDQAQVDMTGNCGNMASGVGPFALDEEL[ 3]LAPL--LnWQMDI   141
XP_002381418    66   NGVGGATPTTSKVAVIRKSKI-PVVDADYTFVQVAPDQAQVDMTGNCGNMASGVGPFALDEEL[13]LAPL--LnWQMHI   151
KJK68742        42   NGVGGTTSTTSKVAVIRKSKK-PGVDVDYTFVQVALDQAQVDTTGNCGNMASGVGPFALDEEL   ---------------   103
```

Fig. 15B (Cont. II)

```
ALS30798         124  RIFNLNSRQASELVIPVYN-GRVHYD---DIDDMHMqrPSARVGLRFLDTVGSC-TGKLLPTGNASDWI    DGLKVSI  194
XP_001396287     148  RIHNTNTGKIVHSSFPVVD-GEAAASGEFAIDGVSG---TAAPVQLDFVDPAGSR-TGKLLPTGQVRDVF   DGVEATC  219
CAK41548         142  RIHNTNTGKIVHSSFPVVD-GEAAASGEFAIDGVSG---TAAPVQLDFVDPAGSR-TGKLLPTGQVRDVF   DGVEATC  213
KJJ34496         127  RIHNTNTGKVIRATFPVVD-GEAASSGTFAIDGVAS---TAARIKLDFLNPAGSR-TGKLLPTGNVVDTF   DGVAATC  198
XP_001819141     127  RIHNTNTGKVIRATFPVVD-GEAASSGTFAIDGVAS---TAARIKLDFLNPAGSR-TGKLLPTGNVVDTF   DGVAATC  198
EHA27337         148  RIHNTNTGKIVHSSFPVVD-GEAAASGEFAIDGVSG---TAAPVQLDFVDPAGSR-TGKLLPTGQVRDVF   DGVEATC  219
EYE99302         151  RIHNTNTGKVIHSSFPIVD-GEAATSGDFSIDGVAG---TAARVQLDFVDPAGSR-TGKLLPTGQVRDTF   DGVVATC  222
CEL09686         148  RIHNTNTGKIIHATFPLAE-GEAAARGELAVDGVAG---TAAPIKLDFIDPAGSR-TGKMLPTGVVRDVF   DGVEATC  219
KJK63554         127  RIHNTNTGKVIRATFPVVN-GEAASSGTFAIDGVAS---TAARIKLDFLNPAGSR-TGKLLPTGNVVDTF   DGVAATC  198
GAO84354         134  RIFNTNTGKVIRSTFPVVD-GEAAAAGDFSIDGVAG---TAAQIRLDFIDPAGSR-TGKLLPTGEVVDCF   DDIPASC  205
GAQ03913         140  RIFNTNTGKVIRSTFPVVD-GEAAAAGDFAIDGVAG---TGARIQLDFIDPAGSR-TGKLLPTGKVVDCL   DGIPASC  211
XP_731519        161  RIFNTNTGKIIRSTFPVVD-GEAAAAGGFAIDGVAS---TGARIRLDFIDPAGSR-TGKLLPTGKSVDCF   DDIPASC  232
KMK55456         131  RIFNTNTGKIIRSTFPVVD-GEAAAAGGFAIDGVAS---TGARIRLDFIDPAGSR-TGKLLPTGKSVDCF   DDIPASC  202
EDP47862         161  RIFNTNTGKIIRSTFPVVD-GEAAAAGGFAIDGVAS---TGARIRLDFIDPAGSR-TGKLLPTGKSVDCF   DDIPASC  232
KEY81347         160  RIFNTNTGKIIRSTFPVVD-GEAAAAGGFAIDGVAS---TGARIRLDFIDPAGSR-TGKLLPTGKSVDCF   DDIPASC  231
XP_001400235     142  RIHNTNTGKIITASPPVVD-GEAASSGNFAIDGVAG---TAARIQLDFVNPAGSV-TGKMLPTGQTRDEF   DGVPATC  213
GAA84478         142  RIHNTNTGKIITASFPVVD-GEAASSGDFAIDGVAG---TAARIRLDFVNPAGSV-TGKMLPTGQTRDKF   DGVSATC  213
XP_001257313     160  RIFNTNTGKVIRSTFPVVD-GEAAAAGDFAIDGVAG---TGARIRLDFIDPAGSR-TGKLLPTGKGIDCF   DDIPASC  231
EHA23360         142  RIHNTNTGKIITASPPVVD-GEAASSGNFAIDGVAG---TAARIQLDFVNPAGSV-TGKMLPTGQTRDEF   DGVPATC  213
GAQ36994         142  RIHNTNTGKIITASFPVVD-GEAASSGDFAIDGVAG---TAARIQLDFVNPAGSV-TGKMLPTGQTRDEF   DGVPATC  213
XP_001270418     159  RIFNTNTGKIIRSTFPVVD-GEAATSGDFAIDGVSG---TAARVRLDFIDPAGSR-TGQLLPTGNVVDIV   DETPTTC  230
XP_015412475     153  RILNTNTGKVIRSRFPVVE-GEAAASGEFAIDGVAG---TAAKIQLDFLDPAGSR-TGKLFPTGKVVDEF   DGVRTTC  224
XP_662991        150  RIHNTNTGKIIHATFPIIN-GEAAAAGELAIDGVAG---TAAPIKLDFVNPAGSR-TGKLLPTEAVKDVF   DGVEATC  221
XP_001210014     153  RIHNTNTGKIIRSRFPVED-GEAASSGSFAIDGVAG---TAAKIQLDFLDPAGSR-TGSLLPTGQVVDTF   DGVSTTC  224
XP_001820453     153  RILNTNTGKVIRSRFPVVE-GEAAASGDFAIDGVAG---TAAKIQLDFLDPAGSR-TGKLFPTGKVVDEF   DGVRTTC  224
XP_002373956     153  RILNTNTGKVIRSRFPVVE-GEAAASGDFAIDGVAG---TAAKIQLDFLDPAGSK-TGKLFPTGKVVDEF   DGVRTTC  224
KJJ36989         153  RILNTNTGKVIRSRFPVVE-GEAAASGDFAIDGVAG---TAAKIQLDFLDPAGSR-TGKLFPTGKVVDEF   DGVRTTC  224
EIT81585         153  RILNTNTGKVIRSRFPVVE-GEAAASGDFAIDGVAG---TAAKIQLDFLDPAGSR-TGKLFPTGKVVDEF   DGVRTTC  224
KJK65623         153  RILNTNTGKVIRSRFPVVE-GEAAASGDFAIDGVAG---TAAKIQLDFLDPAGSK-TGKLFPTGKVVNEP   DGVRTTC  224
CEN62014         185  RIYNTNTRRIVVETVALDAsGDYDETGDYTIAGVST---PGSEVKCTFVEPIGSM-TGKLFPSDGQQQQL[11]FTVRVTL  268
XP_002376737     137  RIYNTNTDRIVIETVALDDsGDYEEDGNFIISGVKS---PGSEVKCRFVKPMGSM-TGKLFPSDNQQQQT[14]FDVRVTL  223
EIT75080         137  RIYNTNTDRIVIETVALDDsGDYEEDGNFIISGVKS---PGSEVKCRFVKPMGSM-TGKLFPSDNQQQQT[14]FDVRVTL  223
XP_001821002     137  RIYNTNTDRIVIETVALDDsGDYEEDGNFIISGVKS---PGSEVKCRFVKPMGSM-TGKLFPSDNQQQQT[14]FDVRVTL  223
XP_001395615     133  RIYNTGTGKLLSAHPVSGsGAFEPEGTHEIAGDPG---KGSPVLLDYRFTIGAElSRGLLPTGNASDMI[ 5]-EFEITI  210
XP_001398476     152  KILNTNTGQHIFETVQVATDGSFREDGDYAIPGVEG---TASPIRVAFLKPCGSM-TGQMPPSGMHQEML[ 9]LAVRVSL  233
KOC09026         942  RIYNTNTDRIVIETVALDDsGDYEEDGNFIISGVKS---PGSEVKCRFVKPMGSM-TGKLFPSDNQQQQT[14]FDVRVTL  1028
CAK46258         124  RIYNTGTGKLLSAHPVSGsGAFEPEGTHEIAGDPG---KGSPVLLDYRFTIGAElSRGLLPTGNASDMI[ 5]-EFEITI  201
XP_015408091     986  RIYNTNTDRIVIETVTLNSsGDYEEDGNFIISGVKT---PGSEVKCRPVKPFGSM-TGKLFPSADQQQQT[12]FDVRVTL  1070
EHA18754         152  KILNTNTGQHIFETVQVATDGSFREDGDYAIPGVEG---TASPIRVAFLKPCGSM-TGQMPPSGMHQEML[ 9]LAVRVSL  233
GAO81732         149  RTYNTNTRQLIVETVQIAPDGTFQEEGEYRIPGVAG---TSSPIRLAFLRPGGSM-TGRLFPSGAQQEML[ 9]FTVRVSL  230
CAK43083         156  KILNTNTGQHIFETVQVATDGSFREDGDYAIPGVEG---TASPIRVAFLKPCGSM-TGQMPPSGMHQEML[ 9]LAVRVSL  237
EYE98603         151  RIYNTNTGQALVETVQVAAdGSFQEGGKYAIPGVEG---TASPVRIAFLNPGGSM-TGRMFPSGLRQETL[ 9]FAVRVSL  232
GAA92128         86   RIYNTNTGQHIVETVQVANdGSFREDGDYAIPGVEG---TASPIKVAFLKPCGSM-TGHMFPSGRHQEML[ 9]LSVRVSL  167
XP_015409321     27   RIHNTNTGKVIRATFPVVD-GEAASSGTFAIDGVAS---TAARVQLDFLNPSGSR-TGKLLPTGNVVDTF   DGVAATC  98
GAQ46340         86   KIYNTNTGQHIIETVQVATDGSFREDGEYAIPGVGG---TASPIKVAFLRPCGSM-TGHMFPSGKHQEML[ 9]LSVRVSL  167
XP_015407774     145  T-----------------SPPdGNFCEDGDYSIAGVRG---TASPIQMTFIKPGGSI-TGRLFPSGAKQEML[10]FIVRVSL  212
XP_001210444     151  RIYNTNTKQHLVETVQVAVdGSFREDGEYSIPGVDG---MASPVRVAPLNPGGSM-TGCMFPSGLRQETL[ 9]FDASWR-  231
KOC12936         142  TVFNTNTQQILVETVHVTPdGRFSEDGDYSIAGVRG---TASPIRMNIIKPAGSM-TGRLFPSGAKQEML[10]FIVRVSL  224
XP_003190455     142  TVFNTNTQQILVETVHVTPdGRFSEDGDYSIAGVRG---TASPIRMNIIKPAGSM-TGRLFPSGAKQEML[10]FIVRVSL  224
XP_002381418     152  TVFNTNTQQILVETVHVTPdGRFSEDGDYSIAGVRG---TASPIRMNIIKPAGSM-TGRLFPSGAKQEML[10]FIVRVSL  234
```

Fig. 15B (Cont. III)

```
KJK68742        104  ----------QILVEAVHVTPdGKFSEDGDYSIAGSRH--SES-----------------------VRVSL  139
ALS30798        195  IDSAVPVVFIRQHDVGITGSEAPATLNANTALLDRLERVRLEAGRRMGLGDVSGSV-------VPKLSLIGPG------------  260
XP_001396287    220  IDVANPCVFVRAEDLEVEGNLTPEEITAHPGLLDRLDSIRRQAGVKMGLADTREAVPGS---VPKICLVSQPgTDTRAVEQ     297
CAK41548        214  IDVANPCVFVRAEDLEVEGNLTPEEITAHPGLLDRLDSIRRQAGVKMGLADTREAVPGS---VPKICLVSQPgTDTRAVEQ     291
KJJ34496        199  IDVANPCTFVRASDLGVEGNLTPDEIEVHPDLLARLDSIRRQAGVKMGLASTPETIPGS---VPKICLVSTPpENERAVQQ     276
XP_001819141    199  IDVANPCTFVRASDLGVDGNLTPDEIEVHPDLLARLDSIRRQAGVKMGLASTPETIPGS---VPKICLVSTPpENERAVQQ     276
EHA27337        220  IDVANPCVFVRAEDLEVEGNLTPEEITVHPGLLDRLDSIRRQAGVKMGLADTRETVPGS---VPKICLVSQPgTDTRAVEQ     297
EYE99302        223  IDVANPCVFVRAAELGAPGNMTPDEITVHTNLLPRLDSIRRQAGVKMGLAETLEKVPGS---VPKICLVSSPaNDARAKEQ     300
CEL09686        220  VDVANPCVFVRAEDLGVEGTLSPDEITAAPGLLERLDSIRRQAGVAMGLAGTLEEVPGS---VPKIGMVSSP-KEA-----     291
KJK63554        199  IDVANPCTFVQASDLGVDGNLTPDEIEMHPDLLARLDSIRRQAGVKMGLASTPETIPGS---VPKICLVSTPpENGRAVQQ     276
GAO84354        206  VDVGNPCVFVRASDLGVRGNLAPDEIDAHPTLLPQLDSIRRQAGVKMGLAETPKEVPGS----VPKICLVSSP-SDSCTSGM   282
GAQ03913        212  IDVGNPCVFVRASDLGVPGNLTPDEIDAHPTLLSQLDSIRRQAGVKMGLAETPKEVPGS---VPKICLVSSP-SDSYTSGM    288
XP_731519       233  VDVGNPCVFVRASDLGVPGNLAPDKIDAHPTLLSQLDSIRRQAGVKMGLAGTTKEVPGS---VPKICLVSSP-SDAYTSGM    309
KMK55456        203  VDVGNPCVFVRASDLGVPGNLAPDKIDAHPTLLSQLDSIRRQAGVKMGLAGTTKEVPGS---VPKICLVSSP-SDAYTSGM    279
EDP47862        233  VDVGNPCVFVRASDLGVPGNLAPDKIDAHPTLLSQLDSIRRQAGVKMGLAGTTKEVPGS---VPKICLVSSP-SDAYTSGM    309
KEY81347        232  VDVGNPCVFVRASDLGVPGNLAPDKIDAHPTLLSQLDSIRRQAGVKMGLAGTTKEVPGS---VPKICLVSSP-SDAYTSGM    308
XP_001400235    214  IDVANPCVFVPASSLGVRGDLTPDDIAAHPDLLQRLDSIRRQAGVKMGIASTTGAVPGS---IPKVCMVSPP--------QP   284
GAA84478        214  IDVANPCVFVPASSLGVRGDLTPDEIAAHPDLLQRLDSIRRQAGVKMGIAPTTDAVPGS---IPKVCMVSPP--------QE   284
XP_001257313    232  IDVGNPCVFVRASDLRVPGNLAPDEIDAHPTLFSQLDSIRRQAGVKMGLAETPTEVPGS---VPKICLVSSP-SDSYTSGM    308
EHA23360        214  IDVANPCVFVSSLGVRGDLTPDEIAAHPDLLQRLDSIRRQAGVKMGIASTTGAVPGS---IPKVCMVSPP--------QP    284
GAQ36994        214  IDVANPCVFVSASSLGVRGDLTPDEIAAHPDLLQRLDSIRRQAGVKMGIAPTTDAVPGS---IPKVCMVSPP--------QE   284
XP_001270418    231  IDVGNPCVFHSSDLGVAGNLTPSEIDSHPTLLTRLDSIRRQAGVRMGLAASPEEVPGS---VPKICLVSTP-SRSSLSDL    307
XP_015412475    225  IDVSNPCCFVLASELGVEGNITPEEIDADPTLLGRLDSIRRQAGVAMGLAETAESVPGS---VPKIGLVASPaMNARASEQ    302
XP_662991       222  IDVANPCVFVKADDLGVSGALTPDEITATPGLLARLDSIRRQAGAKMGLARSPEAVPGS---VPKIGIVSIP-KDD-------  293
XP_001210014    225  IDVGNPCCFVLASDLGVKGTITPDEIDAHPTLLPRLDSIRRQAGVAMGLADHPDGVPGS---VPKIGMVSAPpSNTQASGP    302
XP_001820453    225  IDVSNPCCFVLASELGVEGNITPEEIEAHPTLLDRLDSIRRQAGVAMGLAETAESVPGS---VPKIGLVASPaSNARALEQ    302
XP_002373956    225  IDVSNPCCFVLASELGVEGNITPEEIDAHPTLLDRLDSIRRQAGVAMGLAETAESVPGS---VPKIGLVASPaSNARALEQ    302
KJJ36989        225  IDVSNPCCFVLASELGVEGNITPEEIDAHPTLLDRLDSIRRQAGVAMGLAETAESVPGS---VPKIGLVASPaSNARALEQ    302
EIT81585        225  IDVSNPCCFVLASELGVEGNITPEEIEAHPTLLDRLDSIRRQAGVAMGLAETAESVPGS---VPKIGLVASPaSNARALEQ    302
KJK65623        225  IDVSNPCCFVLASELGVEGNITPEEIDAHPTLLDRLDSIRRQAGVAMGLAETTESVPGS---VPKIGLVASPaSNARATEQ    302
CEN62014        269  IDSANPFVLIDSTSIQ-T-LFKNLSSEVAQNSL--IESIRREAAVAMGLAPTVEAAAQTrgTPKAALVYPP----DSDTA-    340
XP_002376737    224  IDSANPFVLIDTTSISTT--LLGTNPSDSDRNDL---VETIRRAGAVAMGLATDVEAASRTrgTPKVALMYPP-----TFTQAN  297
EIT75080        224  IDSANPFVLIDTTSISTT--LLGTNPSDSDRNDL---VETIRRAGAVAMGLATDVEAASRTrgTPKVALMYPP-----TFTQAN  297
XP_001821002    224  IDSANPFVLIDTTSISTT--LLGTNPSDSDRNDL---VETIRRAGAVAMGLATDVEAASRTrgTPKVALMYPP-----TFTQAN  297
XP_001395615    211  CDIANLCVFANARDFNITGHETAADLTANLDWLAKTQELLGKAAVLAGMSENWKA---------------------------   265
XP_001398476    234  VDAANPFVFVDAASLPVEASSSIAD-AADPVFLGLIEDIRRHGAVRFGLAENVQAAGQVrgTPKIAILSPA----TGDVD-    308
KOC09026       1029  IDSANPFVLIDTTSISTT--LLGTNPSDSDRNDL---VETIRRAGAVAMGLATDVEAASRTrgTPKVALMYPP-----TFTQAN 1102
CAK46258        202  CDIANLCVFANARDFNITGHETAADLTANLDWLAKTQELLGKAAVLAGIRIPDSVVNRV------------iGDAVELDT    269
XP_015408091   1071  IDSANPFVLIDTTSISAT--LLGTNPSDSDRNDL---VESIRRAGAVAMGLATDVEAAGRTrgTPKAALVFPP----TITQAG 1144
EHA18754        234  VDAANPFVFVDAASLPVEASSSIAD-AADPVFLGLIEDIRRHGAVRFGLAENVQAAGQVrgTPKIAILSPA----TGDVD-    308
GAO81732        231  VDAANPFVLVDAASLPIP---DQDRR-PDDPVFLSVIEDIRREGAVQFGLAADVEAAGTVrgTPKIALLSSA----TAEDD-    303
CAK43083        238  VDAANPFVFVDAASLPVEASSSIAD-AADPVFLGLIEDIRRHGAVRFGLAENVQAAGQVrgTPKIAILSPA----TGDVD-    312
EYE98603        233  VDAANPFVLIDVASLPVD--SRLAD-SADPELLALIEDIRRHGAVRFGLAADVQAAGLVrsTPKVALLSRA----RGDAD-    305
GAA92128        168  VDAANPFVFVDAASLPREASSTIAD-AADPAFLALIEDIRQHGAVRFGLAENVQAASQVrgTPKIAILSPA----SGTVD-    242
XP_015409321     99  IDVANPCTFVRASDLGVDGNLTPEEVEAHPDLLVRLDSIRRQAGVKMGLASTPETVPGS---VPKICLVSTPpENRRAIQQ   176
GAQ46340        168  VDAANPFVFVDAASLPREASSATTD-AADPAFLALIEDIRQHGAVRFGLAENVQAASQVrgTPKIAILSPA----SGNVD-    242
XP_015407774    213  VDAANPFVLVDSSTMPAA--YLDSE-ATSRLSLAIIEDIRVAGAVRFGLARATAAAGRVrgTPKIALLYPG----GREVDT    286
XP_001210444         ------------------------------------------------------------------------------------
KOC12936        225  VDAANPFALLSASTMPAA---YHGSE-PTSPLSLGIIEEIRVAGAVRFGLAEDTATAGRViGTPKIALLYPC----RREVDV    298
XP_003190455    225  VDAANPFALLSASTMPAA---YHGSE-PTSPLSLGIIEEIRVAGAVRFGLAEDTATAGRViGTPKIALLYPC----RREVDV    298
XP_002381418    235  VDAANPFALLSASTMPAA---YHGSE-PTSPLSLGIIEEIRVAGAVRFGLAEDTATAGRViGTPKIAHLYPC----RREVDV    308
KJK68742        140  VDAANPFVWVDASTMPAA---YHNSE-PTSALSLGIIEAIRVAGAVRFGLAQDTATAGRImsTPKIALLYPC----RHEIDV    213
```

Fig. 15B (Cont. IV)

```
ALS30798        261   ----TETTTFTARYFTPKACHNAHAV---TGAICTAGAAYIDGSVVCEILSSR[ 1]--[ 5]S    QRRI    STEHPSGV    325
XP_001396287    298   KQTKEKVDLLVRALSVGQPHKAVPI--TVALAVASAARMSGSTVSQVVGEK            RV    D    EAGI    TLGHASGN    361
CAK41548        292   KQTKEKVDLLVRALSVGQPHKAVPI--TVALAVASAARMSGSTVSQVVGEK            RV    D    EAGI    TLGHASGN    355
KJJ34496        277   KQTASDVDVLARSISVGQPHKAVPI--TVALALASAARVQGSIVADVASKQ            PV    D    QAGI    TIGHTSGN    340
XP_001819141    277   KQTASDVDVLARSISVGQPHKAVPI--TVALALASAARVQGSTVADVASKQ            PV    D    QAGI    TIGHTSGN    340
EHA27337        298   KQTKEKVDLLVRALSVGQPHKAVPI--TVALAVASAARVSGSTVSQVVGEK            RV    D    ETGI    TLGHASGN    361
EYE99302        301   NQTVEKVDLVARALSVGQPHKAVPI--TVALALASAARLPGSTVNEVASTN            RV    D    DAGV    TIGHASGN    364
CEL09686        292   -SDGRGVDLVVRALSVGQPHKAVPI--TVALALVTAARLPGSTVAEVTSSD            PV    D    PSRI    TIGHASGN    354
KJK63554        277   KQTASDVDVLARSISVGQPHKAIPI--TVALALASAARVQGSTVADVASKQ            PV    D    QAGI    TIGHASGN    340
GAO84354        283   MQTSKDVDLVVRALSVGQPHKAVPI--TVALALATAARVSGTVVANVVSDQ            PV    D    PAGI    TLGHASGN    346
GAQ03913        289   MQTSKDVDLVVRALSVGQPHKAVPI--TVALALATAARVSGTVVADVVSDK            PV    D    SAGI    TLGHASGN    352
XP_731519       310   MQTPKDVDLVVRALSVGQPHKAVPI--TVALALATAARVSGTVVADVVSDK            PV    D    PAGI    TLGHASGK    373
KMK55456        280   MQTPKDVDLVVRALSVGQPHKAVPI--TVALALATAARVSGTVVADVVSDK            PV    D    PAGI    TLGHASGK    343
EDP47862        310   MQTPKDVDLVVRALSVGQPHKAVPI--TVALALATAARVSGTVVADVVSDK            PV    D    PAGI    TLGHASGK    373
KEY81347        309   MQTPKDVDLVVRALSVGQPHKAVPI--TVALALATAARVSGTVVADVVSDK            PV    D    PAGI    TLGHASGK    372
XP_001400235    285   SKGKDPVDLLVRAISVGQPHKAVPI--TVALAVSAAARVTGSTVEDATNQD            RV    S    DAGL    TIGHASGN    348
GAA84478        285   SKGKDSVDLLVRAISVGQPHKAVPI--TVALAVSAAARVGGSTVEDATNKD            RV    S    DSGL    TIGHASGN    348
XP_001257313    309   MQTSKDVDLVVRALSVGQPHKAVPI--TVALALATAARVSGTVVADVVSDK            PV    D    PAGI    TLGHASGN    372
EHA23360        285   SKEKDPVDLLVRAISVGQPHKAVPI--TVALAVSAAARVTGSTVEDATNQD            RV    S    DAGL    TIGHASGN    348
GAQ36994        285   SKGKDSVDLLVRAISVGQPHKAVPI--TVALAVSAAARVVGSTVEDATNKD            RV    S    DAGL    TIGHASGN    348
XP_001270418    308   KQSIYDVDLVVRALSVGQPHKAVPI--TVALALAAAARVVGSVVASVMSNQ            PV    D    SGGI    TLGHASGN    371
XP_015412475    303   GQTQADVDLLVRALSVGQPHKAVPI--TVALALAAAQVSGSVVAGVTSGK             AV    D    PAGI    TLGHASGK    366
XP_662991       294   -SR----VDLVVRALSVGQPHKAVPI--TVALALATAARLPGSTVADVTSSD           PV    D    PTGI    TIGHASGS    353
XP_001210014    303   A------VDVVRALSVGQPHRAVPI--TVALALAAAAKVPGSVVASMTKVP            PV    D    ETGI    TLGHASGT    361
XP_001820453    303   GQTEADVDLLVRALSVGQPHKAVPI--TVALALAAAARVPGSVVAGVTSGE            LV    D    PAGI    TLGHASGK    366
XP_002373956    303   GQTEADVDLLVRALSVGQPHKAVPI--TVALALAAAARVPGSVVAGVTSGE            LV    D    PAGI    TLGHASGK    366
KJJ36989        303   GQTEADVDLLVRALSVGQPHKAVPI--TVALALAAAARVPGSVVAGVTSGE            LV    D    PAGI    TLGHASGK    366
EIT81585        303   GQTEADVDLLVRALSVGQPHKAVPI--TVALALAAAARVPGSVVAGVTSGE            LV    D    PAGI    TLGHASGK    366
KJK65623        303   GQTEADVDLLVRALSVGQPHKAVPI--TVALALAAAARVPGSVVAGVTSGE            LV    D    PAGI    TLGHASGK    366
CEN62014        341   --------DVRIQAYSMGLPHPSLQL--TGAVTVAVALSYPDTVVAELAAMA[ 4]--[ 9]E[ 9]EREV    RIAHSKGV    417
XP_002376737    298   GSKKSRPDIRVQAYSMGLPHPSLQL--TGAVTIAVALSYPGTIAAGLSAMG[ 4]GA[12]D[ 8]ERDV    LIEHSQGT    385
EIT75080        298   GSKKSRPDIRVQAYSMGLPHPSLQL--TGAVTIAVALSYPGTIAAGLSAMG[ 4]GA[12]D[ 8]ERDV    LIEHSQGT    385
XP_001821002    298   GSKKSRPDIRVQAYSMGLPHPSLQL--TGAVTIAVALSYPGTIAAGLSAMG[ 4]GA[12]D[ 8]ERDV    LIEHSQGT    385
XP_001395615          ------------------------------------------------------------- --    -    ----    --------
XP_001398476    309   ------GVDIEVKAFSMGKPHASLQL--TGAVCLGAATIIHGTIAWDLAHA-[ 1]EG[11]D[ 5]AVPV    GIREPAGV    383
KOC09026       1103   GSKKSRPDIRVQAYSMGLPHPSLQL--TGAVTIAVALSYPGTIAAGLSAMG[ 4]GA[12]D[ 8]ERDV    LIEHSQGT   1190
CAK46258        270   LEISHPVGTMAVFVQTEMPMKDEPVfeTSRLFEPPAASWLELYTYPVASGQ[ 4]ND[24]F[ 9]QGHI[ 1]-IWHHDGF    372
XP_015408091   1145   GSIKARPDIRIQAYSMGLPHPSLQL--TGAVTIAVALSYPGTIVAGLSAMG[ 4]GT[12]Y[ 8]GRDV    LIEHSQGT   1232
EHA18754        309   ------GVDIEVKAFSMGKPHASLQL--TGAVCLGAATIIHGTIAWDLAHA-[ 1]EG[11]D[ 5]A---    --------    372
GAO81732        304   ------EADLRVLAFTMGKAHASLQL--TGAVCVGAATVIHGTIAWELAQ--[ 1]GK[12]N[ 5]PLSV    GIREPAGV    378
CAK43083        313   ------GVDIEVKAFSMGKPHASLQL--TGAVCLGAATIIHGTIAWDLAHA-[ 1]EG[11]D[ 5]AVPV    GIREPAGV    387
EYE98603        306   ------GVDIEVRAFTMGKPHASLQL--TGAVCLGAATVIHGTIAWDLAHA-[ 1]EG[12]G[ 5]A---    --------    370
GAA92128        243   ------GVDIEVKAFSMGKPHPSLQL--TGAVCLGAATIIHGTIAWDLAHI-[ 1]EG[11]N[ 5]AVPV    GIRESAGV    317
XP_015409321    177   KQTVRDVDVLARSISVGQPHKAIPI--TVALALASAARVQGSTVADVASKQ            PV    D    QAGI    TIGHASGN    240
GAQ46340        243   ------GVDIEVKAFSMGKPHPSLQL--TGAVCLGAATIIHGTIAWDLAHV-[ 1]VG[11]D[ 5]AVPV    GIRESAGV    317
XP_015407774    287   EGRINEADIEVLPFSLGQPHPSLQL--TGAVCLGTALSIPETVAWDLRRQE[ 4]HH[12]P[ 3]TVKR[14]LETHENGE    383
XP_001210444          ------------------------------------------------------------- --    -    ----    --------
KOC12936        299   GRHIDETDIEVLPFSLGQPHPSLQL--TGAVCVGTALSIPGTVAWDIQRQ-[ 4]HH[12]P[ 3]TVK-[ 1]LLEHPSGL    380
XP_003190455    299   GRHIDEADIEVLPFSLGQPHPSLQL--TGAVCVGTALSIPGTVAWDIQRQ-[ 4]HH[12]P[ 5]RGG-[ 1]VGMHENGE    382
```

Fig. 15B (Cont. V)

```
XP_002381418   309   GRHIDEADIEVLPFSLGQPHPSLQP---TGAVCVGTALSIPGTVAWDIQRQ-[4]HH[12]L[3]TVK-[ 1]LLKHPSGL   390
KJK68742       214   GRRIDETDIEVLPFSLGQPHPSLQL---TGAVCVGTALSIPGTVAWDVQPQ-[4]HH[12]P[3]TVSL     LLKHPSGL   295

ALS30798       326   LE   VGLV---PPENA-AqslVDVAVVERSVALIAH      ARVYYTT[  81]   443
XP_001396287   362   LL   VGAT---FDEEG-I----LRFATVFRTARRLFE      GRIFWKG           395
CAK41548       356   LL   VGAT---FDEEG-I----LRFATVFRTARRLFE      GRIFWKG           389
KJJ34496       341   LL   VGAD---FDPNG-A----LSAATVFRTARRLFE      GRIFWKD[   3]     377
XP_001819141   341   LL   VGAD---FDPNG-A----LSAATVFRTARRLFE      GRIFWKD[   3]     377
EHA27337       362   LL   VGAT---FDDEG-T----LRFATVFRTARRLFE      GRIFWKG           395
EYE99302       365   LL   VGAT---FDENG-G----LNAATVFRTARRVFE      GRIFWKN[  13]     411
CEL09686       355   IL   VGAT---FGADG-G----LEFATVFRTARRLFE      GRIFWK-           387
KJK63554       341   LL   VGAD---FDPNG-A----LSAATVFRTARRLFE      GRTECGE[1343]    1717
GAO84354       347   LL   VSAD---FDAEG-H----LSCATVYRTARRIME      GRVFWKD[   3]     383
GAQ03913       353   LL   VSAD---FDPSG-R----LGCATVYRTARRIME      GRVFWRD[   3]     389
XP_731519      374   LL   VGAD---FDPTG-H----VSCATVYRTARRIME      GRVPWKG[   3]     410
KMK55456       344   LL   VGAD---FDPTG-H----VSCATVYRTARRIME      GRVPWKG[   3]     380
EDP47862       374   LL   VGAD---FDPTG-H----VSCATVYRTARRIME      GRVPWKG[   3]     410
KEY81347       373   LL   VGAD---FDPTG-H----VSCATVYRTARRIME      GRVPWKG[   3]     409
XP_001400235   349   LL   VGAQ---F-END-Q----LTAATVFRTARRLFE      GQIYWKS           381
GAA84478       349   LL   VGAK---F-EED-Q----LTAATVFRTARRLFE      GQIYWKS           381
XP_001257313   373   LL   VGAD---FDPSG-R----LSCATVYRTARRIME      GRVFWKD[   3]     409
EHA23360       349   LL   VGAQ---F-END-Q----LTAATVFRTARRLFE      GRIYWKS           381
GAQ36994       349   LL   VGAK---F-EED-Q----LTAATVFRTARRLFE      GQIYWKS           381
XP_001270418   372   LL   VSAD---IDPAG-H----LSCATVYRTARRIME      GRVFWRD           405
XP_015412475   367   LV   VGAE---FGSDG-S----LSHATVFRTARRLME      GRVFWKS           400
XP_662991      354   IL   VGAT---FGADG-G-----LDFATVFRTARRLFE     GRIFWK-           386
XP_001210014   362   LM   VGAE---FGPDG-Q----LSHATVFRTARRLME      GRVPWKA           395
XP_001820453   367   LV   VGAE---FGVDG-S----LSHATVFRTARRLME      GKVFWKS           400
XP_002373956   367   LV   VGAE---FGVDG-S----LSHATVFRTARRLME      GKVFWKS           400
KJJ36989       367   LV   VGAE---FGVDG-S----LSHATVFRTARRLME      GKVFWKS           400
EIT81585       367   LV   VGAE---FGVDG-S-----LSHATVFRTARRLME     GKVFWKS           400
KJK65623       367   LV   VGAE---FGADG-S----LSHGTVFRTARRLME      GKVFWKS           400
CEN62014       418   IK   VGVV---MARNG-G----VASCAVSRTARRLFE      GRIRYYV           451
XP_002376737   386   IK   VGVV---MDDVG-E----VASCAVSRTARRLFE      GKVRYYI[   5]     424
EIT75080       386   IK   VGVV---MDDVG-E----VASCAVSRTARRLFE      GKVRYYI[   5]     424
XP_001821002   386   IK   VGVV---MDDVG-E----VASCAVSRTARRLFE      GKVRYYI[   5]     424
XP_001395615         --   --------------------------------      --------
XP_001398476   384   IH[4]LGMD------RHG-A-idVDRVAVYRTARRLFE     GRVFYRP           421
KOC09026      1191   IK   VGVV---MDDVG-E----VASCAVSRTARRLFE      GKVRYYI[   5]    1229
CAK46258       373   LH[1]LFVQtlGDMGGkSaltLSHSNVLCAQGWYML        --------          406
XP_015408091  1233   IK   VDVE---MDNGG-E----VASCSVSRTARRLFE      GKVRYYI[   5]    1271
EHA18754       373   --[2]LGMD------RHG-A-idVDRVAVYRTARRLFE     GRVFY--           404
GAO81732       379   IH[4]LGMD------HTG-E-vsVDNVAVFRTARRLFE     GNVYYRV           416
CAK43083       388   IH[4]LGMD------RHG-A-idVDRVAVYRTARRLFE     GRVPYRP           425
EYE98603       371   --[2]LGMD------WKG-D-idVDRVAVFRTARRLFE     GSVFYRA           404
GAA92128       318   VH[4]LGID------RKG-A-idVDRVAVYRTARRLFE     GRVFYRP           355
XP_015409321   241   LL   VGAD---FDPTG-A----LSAATVFRTARRLFE      GRIFWKD[   3]     277
GAQ46340       318   IH[4]LGID------RKG-A-idVDRVAVYRTARRLFE     GRVPYRP           355
XP_015407774   384   TS   VES----------------V-SVFRTARRLFE       GKVFYRL           407
XP_001210444         --   --------------------------------      --------
KOC12936       381   MG   VEV----------------TWGCTRTGRHPWR[ 6]---------                404
XP_003190455   383   TS   VES----------------V-SMFRTARRLFE       --------          399
XP_002381418   391   MG   VEV----------------AWGCTRTGRHPWR[13]KRCFIAC[   8]   436
KJK68742       296   MD   MEVKleMHEDR-E-taVESVSVFRTARRLFE        GKVFYRL           333
```

Splitmarker design of An07g00760 (*ictA*) using the *A. oryzae pyrE* selection marker Splitmarker design of An07g00760 (*ictA*) using the *E. coli* hygromycin B phosphotransferase (*hph*) selection marker Splitmarker design for gene An07g09220 (*ictA*) using the *A. oryzae pyrE* selection marker Scheme for itaconic acid biosynthesis and catabolism Itaconic acid degradation pathway

PRODUCTION OF ITACONIC ACID

CROSS-REFERENCE TO RELATED PATENT APPLICATIONS

This application is a U.S. National Stage Application under 35 U.S.C. § 371 of International Patent Application No. PCT/EP2017/071466, filed Aug. 25, 2017, which claims the benefit of priority under 35 U.S.C. Section 119(e) of European Patent Application number EP 16185980.6 filed Aug. 26, 2016, both of which are incorporated by reference in their entireties. The International Application was published on Mar. 1, 2018, as International Publication No. WO 2018/037123 A1.

The invention relates to the field of microbial production, more specifically production of itaconic acid (itaconate), more specifically production of itaconate in fungi.

Production and metabolism of itaconic acid in microbial cells has been studied extensively for several decades (Calam, C. T. et al., 1939, Thom. J. Biochem., 33:1488-1495; Bentley, R. and Thiessen, C. P., 1956, J. Biol. Chem. 226:673-720; Cooper, R. A. and Kornberg, H. L., 1964, Biochem. J., 91:82-91; Bonnarme, P. et al., 1995, J. Bacteriol. 117:3573-3578; Dwiarti, L. et al., 2002, J. Biosci. Bioeng. 1:29-33), but the metabolic pathway for itaconic acid has not been unequivocally established (Wilke, Th. and Vorlop, K.-D., 2001, Appl. Microbiol. Biotechnol. 56:289-295; Bonnarme, P. et al., 1995, J. Bacteriol. 177:3573-3578). Two complicating factors in this respect are that the biosynthesis route for itaconic acid is thought to occur both in the cytosol and the mitochondria (Jaklitsch, W. M. et al., 1991, J. Gen. Microbiol. Appl. 6:51-61) and that aconitase, the enzyme that interconverts citric acid into cis-aconitate, and vice versa, and other enzymes in the metabolic pathway have been found to be present in many isoforms in microbial cells.

Production of itaconic acid is now commercially achieved in *Aspergillus terreus*, which has physiological similarity to *A. niger* and *A. oryzae*. However, these latter two accumulate citric acid, due to the absence of cis-aconic acid decarboxylase (CAD) activity. Substrates used by these fungi include mono- and disaccharides, such as glucose, sucrose and fructose and starches, as they exist in forms that are degradable by the micro-organism, and molasses. Recently, it has been discovered that also glycerol is a useful substrate in itaconic acid production by *A. terreus* (U.S. Pat. No. 5,637,485).

Figure 21:
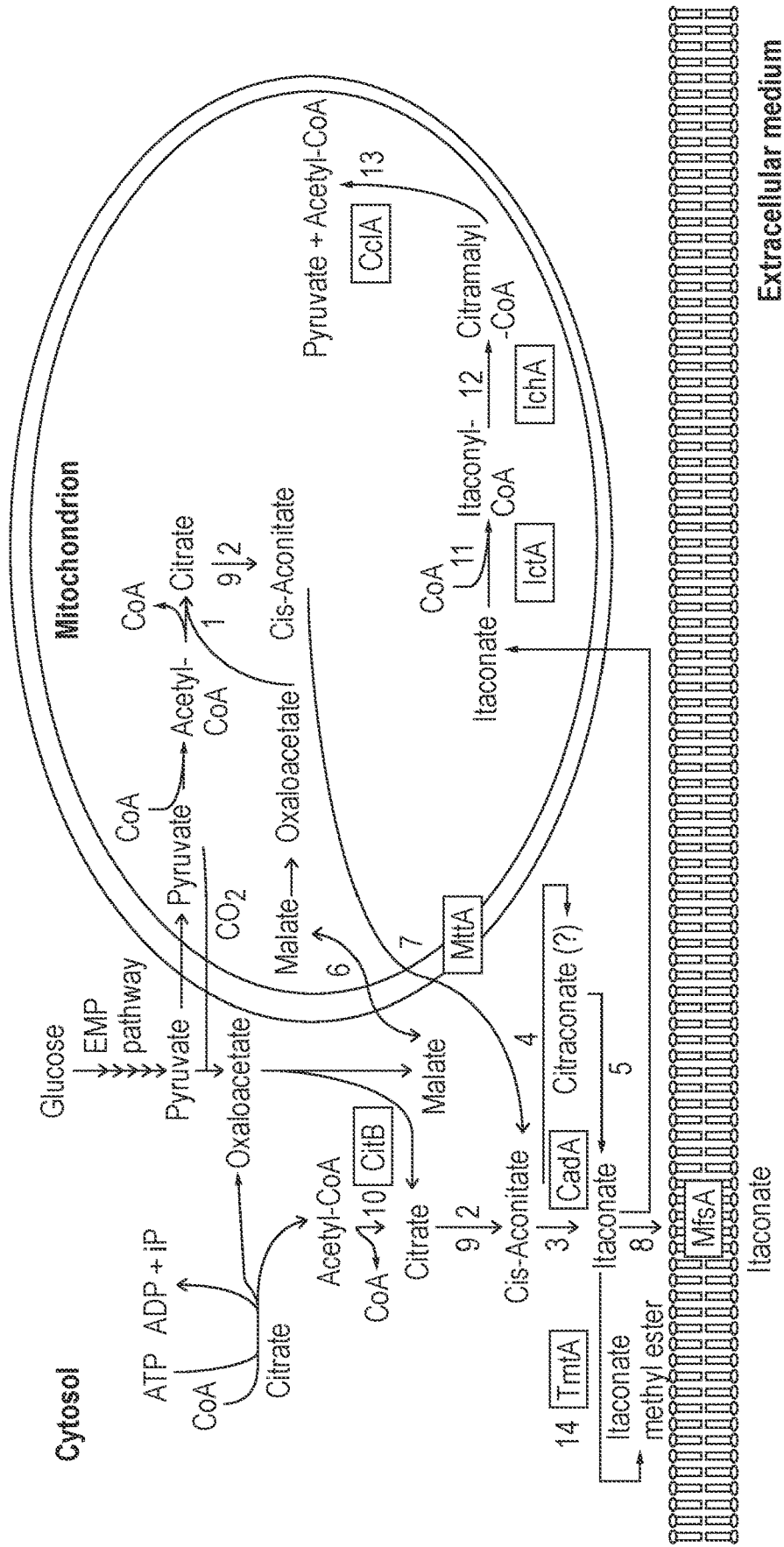

The general scheme currently envisioned for itaconic acid biosynthesis is given in FIG. 21, wherein clearly the existence of the biosynthetic route both in the cytosol and the mitochondria is depicted and the connection between these two compartments. At several points of this scheme possibilities exist to try to improve the existing commercial production of itaconic acid in micro-organisms.

SUMMARY OF THE INVENTION

The present inventors now have found mutant strains selected for increased itaconic acid resistance and reduced itaconic acid degradation and/or biochemical conversion, thus producing improved levels of itaconic acid. Moreover the present inventors have found that inhibition of the activity of itaconyl-CoA transferase (EC 2.8.3.-), itaconyl-CoA hydratase/citramalyl-CoA hydro-lyase (EC 4.2.1.56) or citramalyl-CoA lyase (EC 4.1.3.25) and/or inhibition of the expression of the genes encoding these enzymes from the organism in which itaconic acid is produced, e.g. *Aspergillus* are able to overcome the toxic effects caused by itaconic acid and concomitantly to boost the production of itaconic acid. Accordingly, the invention comprises methods to increase production of itaconic acid in a micro-organism by increasing resistance to the toxic effects of itaconic acid and decreasing itaconic acid degradation and/or biochemical conversion. One approach to obtain increased itaconic acid production is by selection of mutant strains of itaconic acid producing organisms which are resistant to the toxic effects of itaconic acid. Another approach is by inhibiting the functioning of the enzyme itaconyl-CoA transferase (EC 2.8.3.-), and/or itaconyl-CoA hydratase (citramalyl-CoA hydro-lyase, EC 4.2.1.56) and/or citramalyl-CoA lyase (EC 4.1.3.25) or inhibiting the expression of the genes encoding these enzymes. Said inhibition can be effected by mutation of the gene coding for said itaconyl-CoA transferase and/or itaconyl-CoA hydratase (citramalyl-CoA hydro-lyase) and/ or citramalyl-CoA lyase (EC 4.1.3.25), wherein said mutation is chosen from:

a) mutation of the promoter or insertion of an inducible promoter;
b) mutation of the coding sequence, chosen from insertion, deletion or change of one or more nucleotides;
c) insertion of a protein binding site; and
d) combinations thereof.

In an alternative embodiment, the expression of said enzyme is silenced, which can be effected by:

a) antisense silencing;
b) sense co-suppression; or
c) RNA interference.

Further comprised in the invention is a method according to any of the above, wherein said micro-organism is a micro-organism which naturally produces itaconic acid, wherein optionally said micro-organism is further provided with a gene coding for the enzyme aconitase and/or a gene coding for the enzyme citrate synthase, 2-methylcitrate dehydratase, and/or cis-aconitate decarboxylase. Also genes coding for transporter proteins that can transport aconitase (-metabolites) such as *Aspergillus terreus* ATEG_09970.1 or ATEG_09972.1 can add to the production of itaconic acid.

Alternatively, said micro-organism is genetically constructed to produce itaconic acid, preferably by introducing a gene coding for the enzyme cis-aconitic acid decarboxylase, wherein optionally said micro-organism is further provided with a gene coding for the enzyme aconitase and/or a gene coding for the enzyme citrate synthase, and/or 2-methylcitrate dehydratase and/or aconitase transporters such as *Aspergillus terreus* ATEG_09970.1 or ATEG_09972.1. Preferably, said micro-organism is an *Aspergillus*, preferably *A. terreus* or *A. niger*.

Another embodiment of the invention is a micro-organism, preferably *Aspergillus*, more preferably *A. terreus* or *A. niger*, in which expression of the gene coding for the enzyme itaconyl-CoA transferase and/or itaconyl-CoA hydratase (citramalyl-CoA hydro-lyase) and/or citramalyl-CoA lyase (EC 4.1.3.25) is inhibited.

LEGENDS TO THE FIGURES

FIG. 1: Controlled fermentation of *Aspergillus terreus* NRRL 1960 showing itaconic acid production and degradation. Glucose concentration (g/l), itaconic acid titer (g/l) and biomass (g DWT/kg) are shown in relation to fermentation time (hours).

Figure 2A:
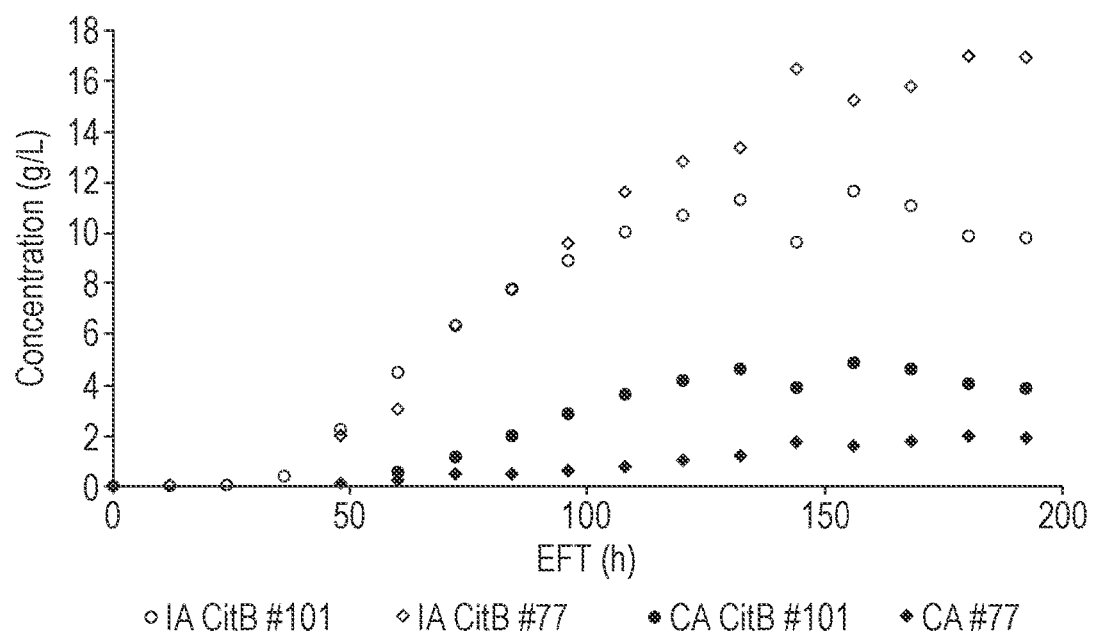
Figure 2B:
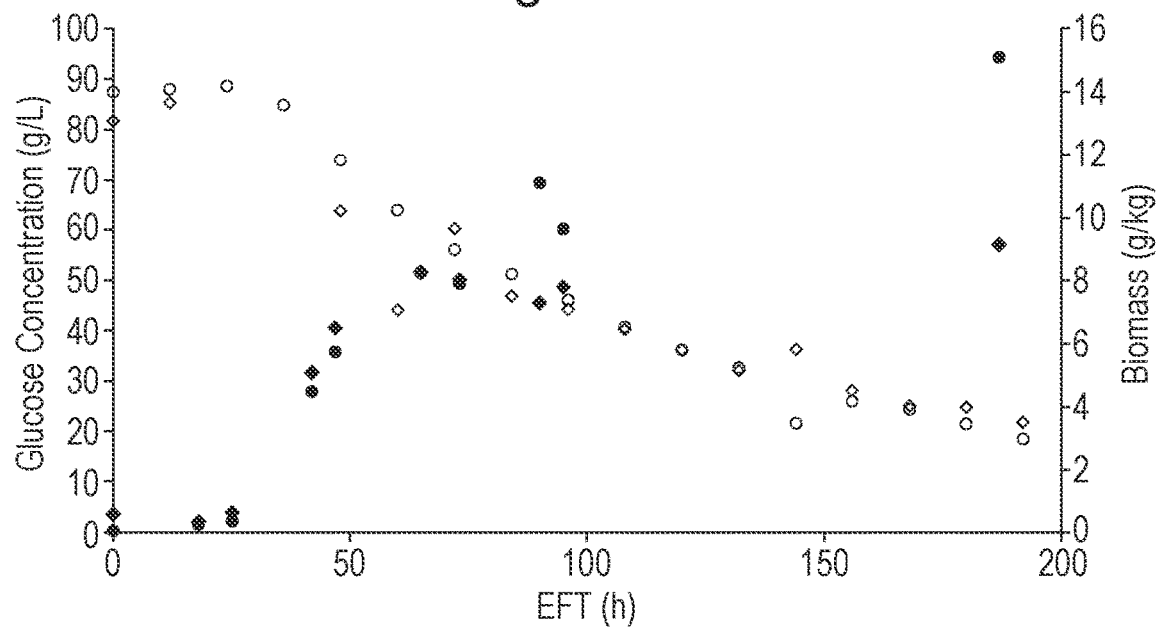

FIG. 2: Controlled fermentation of *Aspergillus niger* strains CitB #77 and CitB #101 producing IA and CA, showing itaconic acid production and degradation. A.

itaconic acid (IA) titer and citric acid (CA) titer (g/l) and B. glucose concentration (g/l), and biomass (g/kg) are shown in relation to fermentation time EFT (h).

Figure 3:
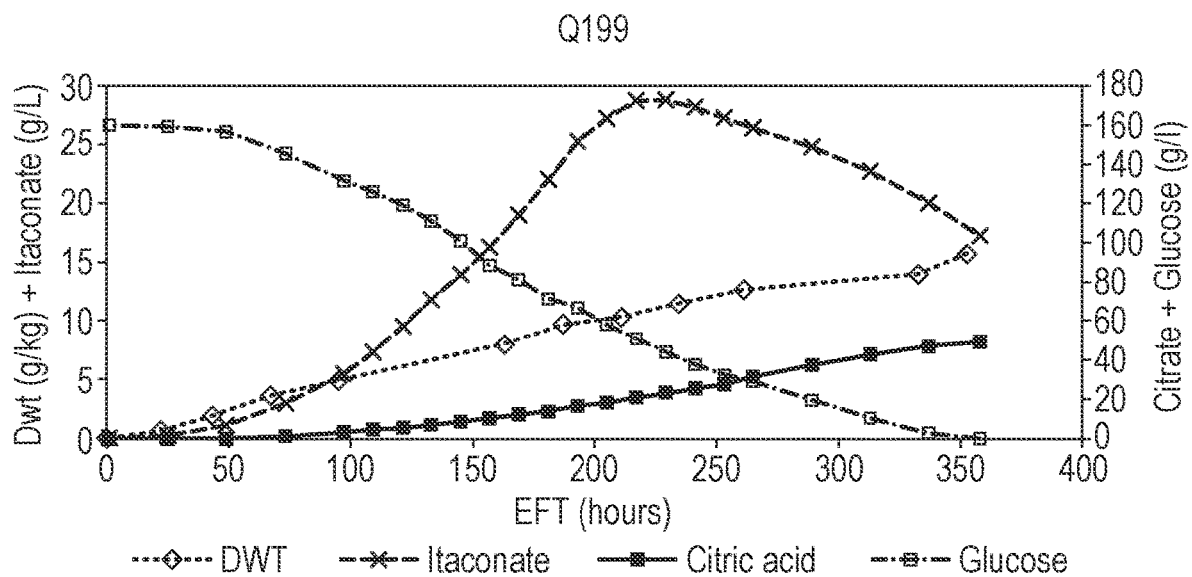

FIG. 3: Controlled fermentation of an IA producing *Aspergillus niger* strain Q199 (CBS 143051), derived from an industrial citric acid production strain, showing citric acid production and itaconic acid production and degradation. Glucose concentration (g/l), itaconate titer (g/l), citrate titer (g/L) and biomass (g DWT/kg) are shown in relation to fermentation time EFT (hours).

Figure 4:
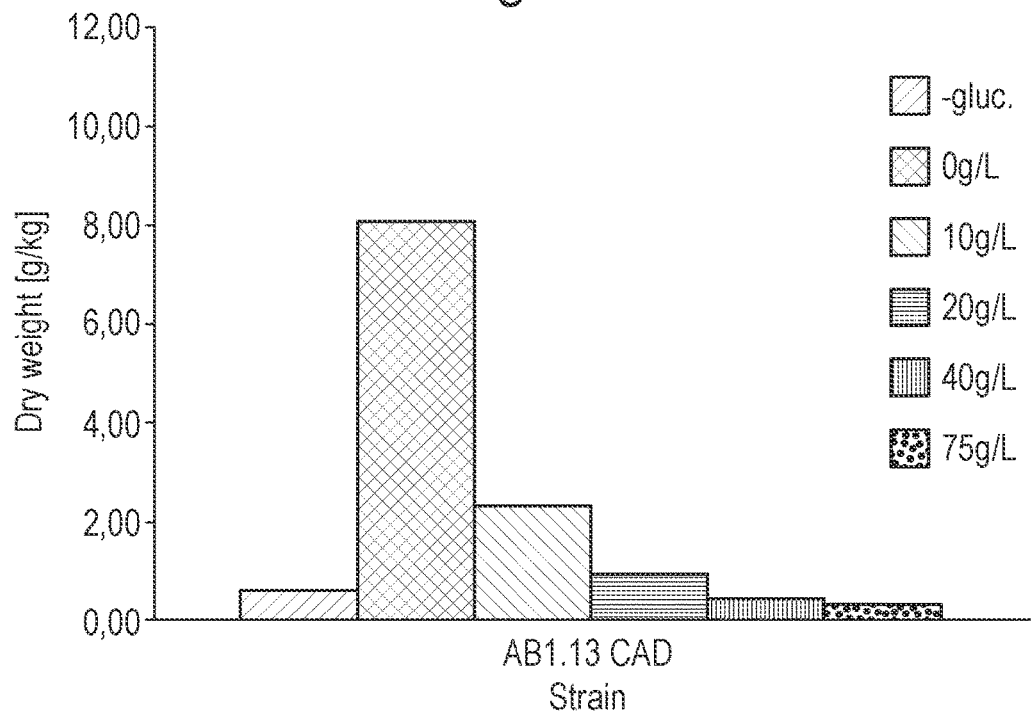

FIG. 4: Growth of AB1.13 CAD 4.1 (CBS 141653) strain in M12+Cu supplemented with several concentrations of itaconic acid. Medium devoid of C-source is used as negative control. An extracellular concentration of 10 g/l IA in the production medium results in an 75% decrease in biomass development. At 20 g/l IA growth and even higher concentrations of IA further deteriorated growth is observed after 7 days of incubation at 33° C.

Figure 5A:
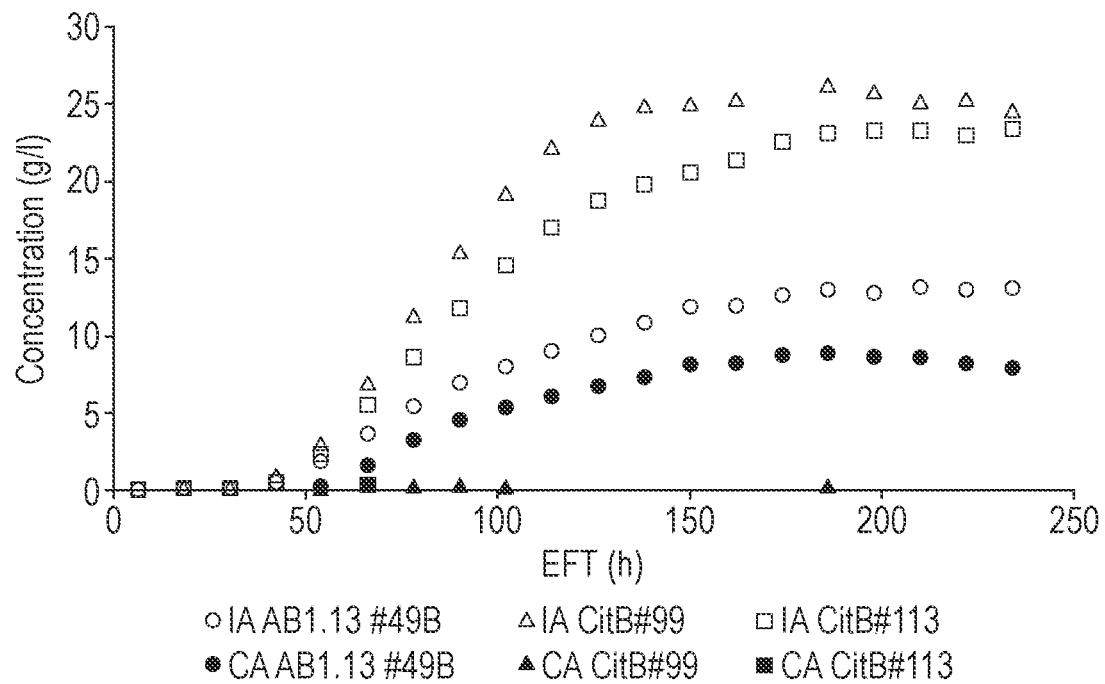
Figure 5B:
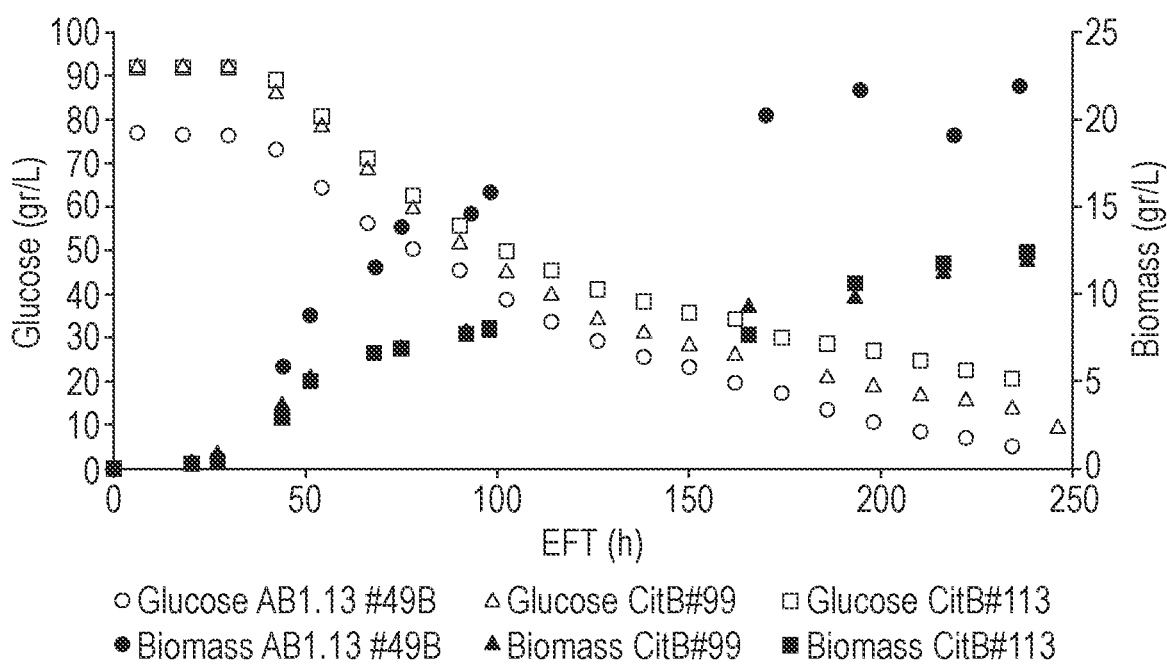

FIG. 5: Organic acid production and biomass formation in controlled fermentation of *A. niger* IA producing strains CitB #99 (CBS 141659) and #113 (CBS 141660) showing reduced biomass formation compared to AB1.13 #49B (CBS 141657). A. itaconic acid (IA) titer and citric acid (CA) titer (g/l) and B. glucose concentration (g/l), and biomass (g/kg) are shown in relation to fermentation time EFT (h).

Figure 6:
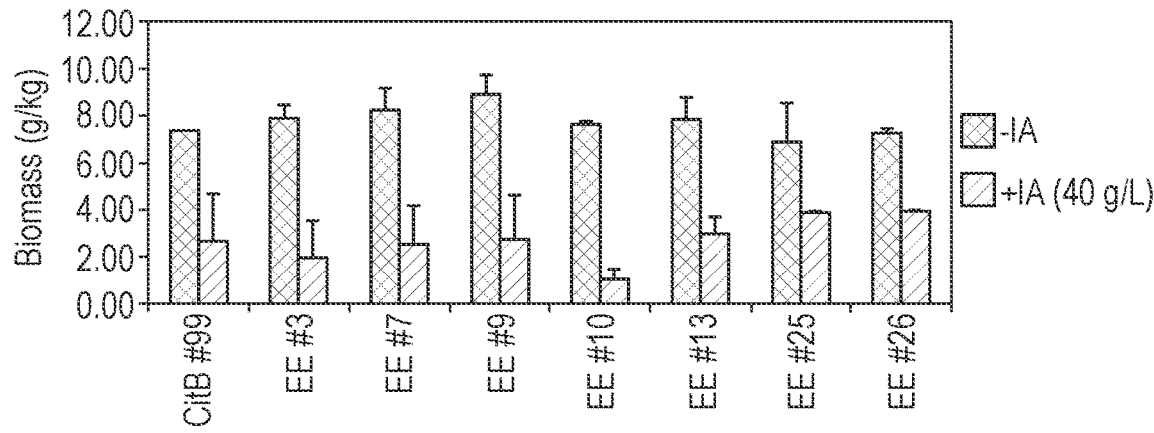

FIG. 6: Biomass generation of shakeflask experiment with evolution mutants EE #3, #7, #9, #10, #13, #25 (CBS 141661), and #26 (CBS 141662) and CitB #99 (CBS141659). Shakeflasks were filled with production medium both with and without IA. Evolution experiment mutant strains and their parental strain CitB #99 were used in this experiment. This experiment was performed in duplicate. Biomass (g/kg) is shown in relation to fermentation condition (+/−IA) after 5 days of incubation at 33° C.

Figure 7:
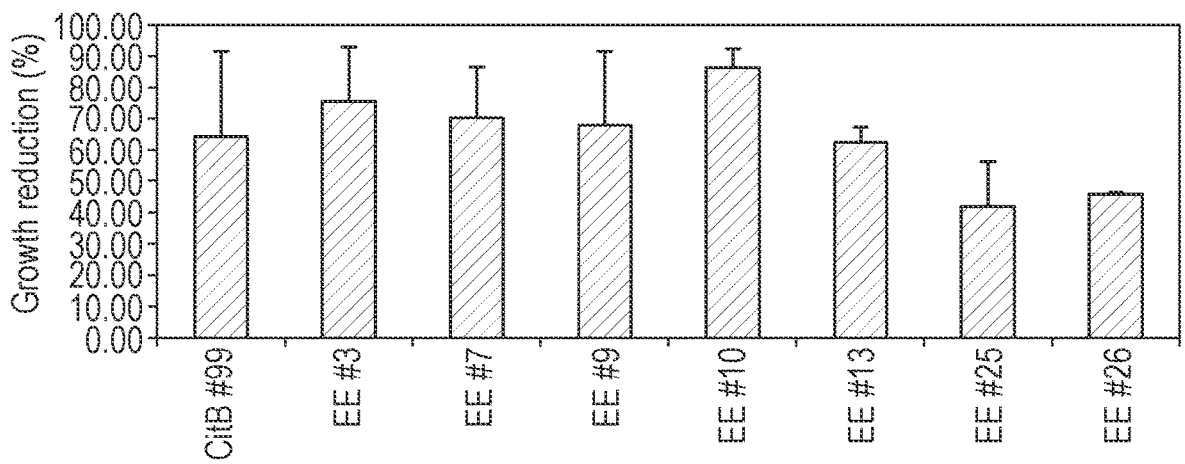

FIG. 7: Average growth inhibition of shakeflask experiment with evolution mutants EE #3, #7, #9, #10, #13, #25 (CBS 141661), and #26 (CBS 141662) and CitB #99 (CBS 141659). Shakeflasks were filled with production medium with and without IA. Evolution experiment mutant strains and their parental strain CitB #99 were used in this experiment. This experiment was performed in duplicate. Reduction of growth by IA is calculated by dividing biomass values with IA by these without IA after 5 days of incubation at 33° C.

Figure 8:
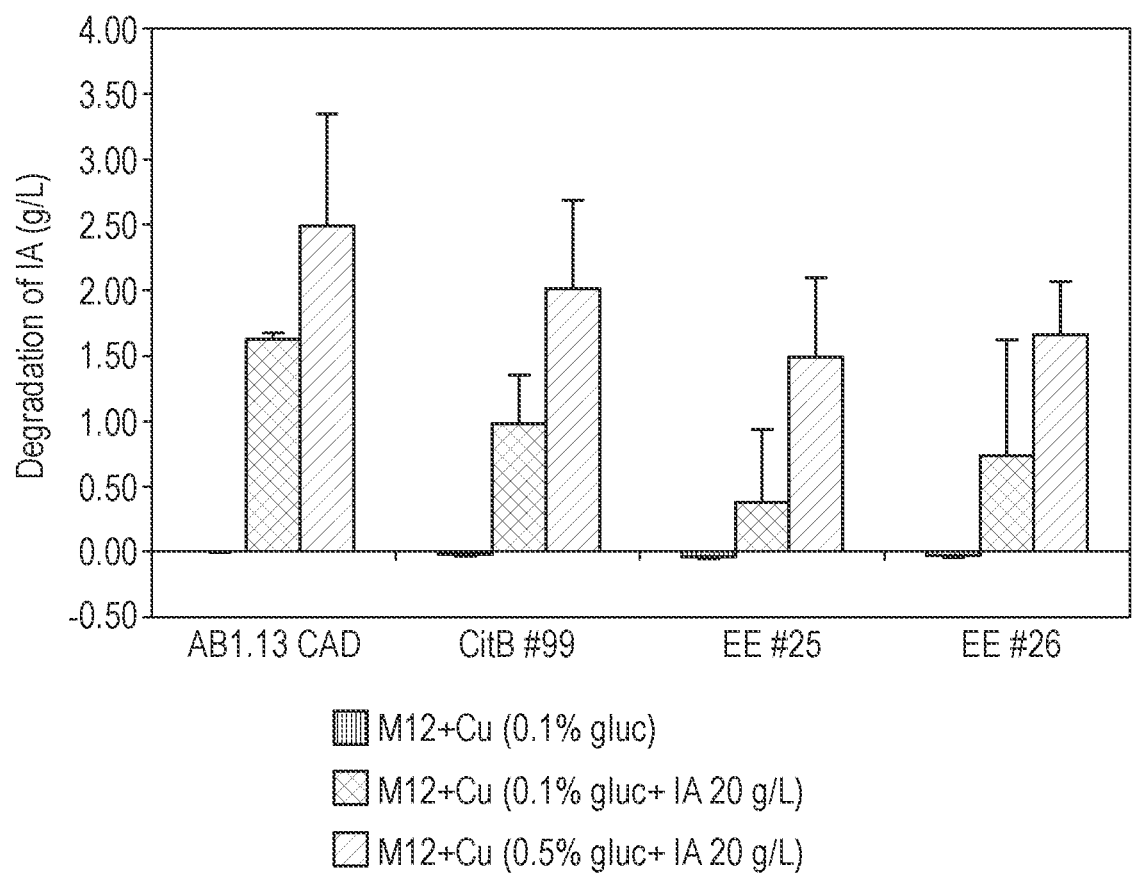

FIG. 8: Degradation of IA in shakeflask experiment. Shakeflasks were filled with production medium supplemented with 20 g/l IA and glucose (1 g/l and 5 g/l). Production medium only supplemented with 1 g/l glucose was added as positive control for this experiment. Evolution experiment mutant strains EE #25 (CBS 141661), EE #26 (CBS 141662) and their parental strain CitB #99 (CBS 141659) and AB1.13 CAD 4.1 (CBS 141653) were used in this experiment. This experiment was performed in duplicate. Degradation of IA is expressed in IA (g/l) decrease in the culture fluid after 5 days of incubation at 33° C.

Figure 9:
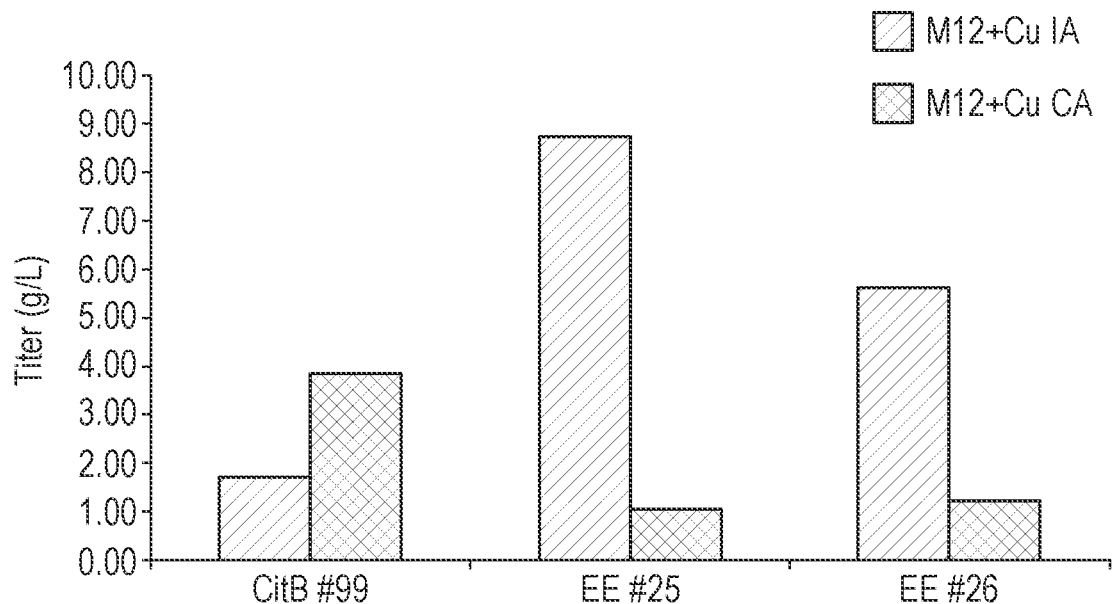

FIG. 9: IA and CA production in IA resistant strains. Shakeflasks were filled with production medium. Evolution experiment mutant strains EE #25 (CBS 141661), EE #26 (CBS 141662) and their parental strain CitB #99 (CBS 141659) were used in this experiment. Itaconic acid and citric acid levels obtained in these cultivations are given in g/l after 5 days of incubation at 33° C.

Figure 10:
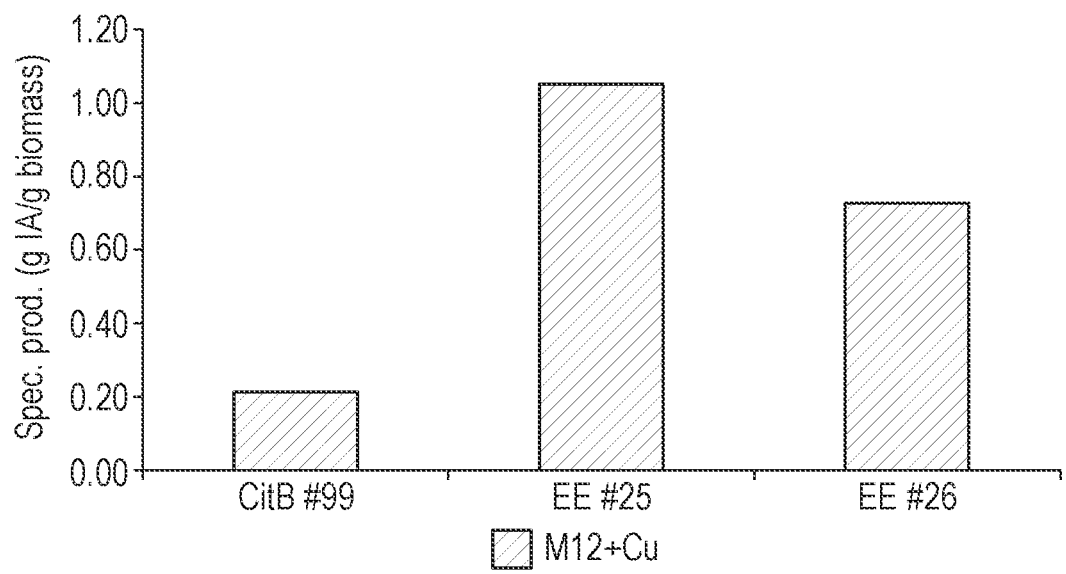
Figure 16A:
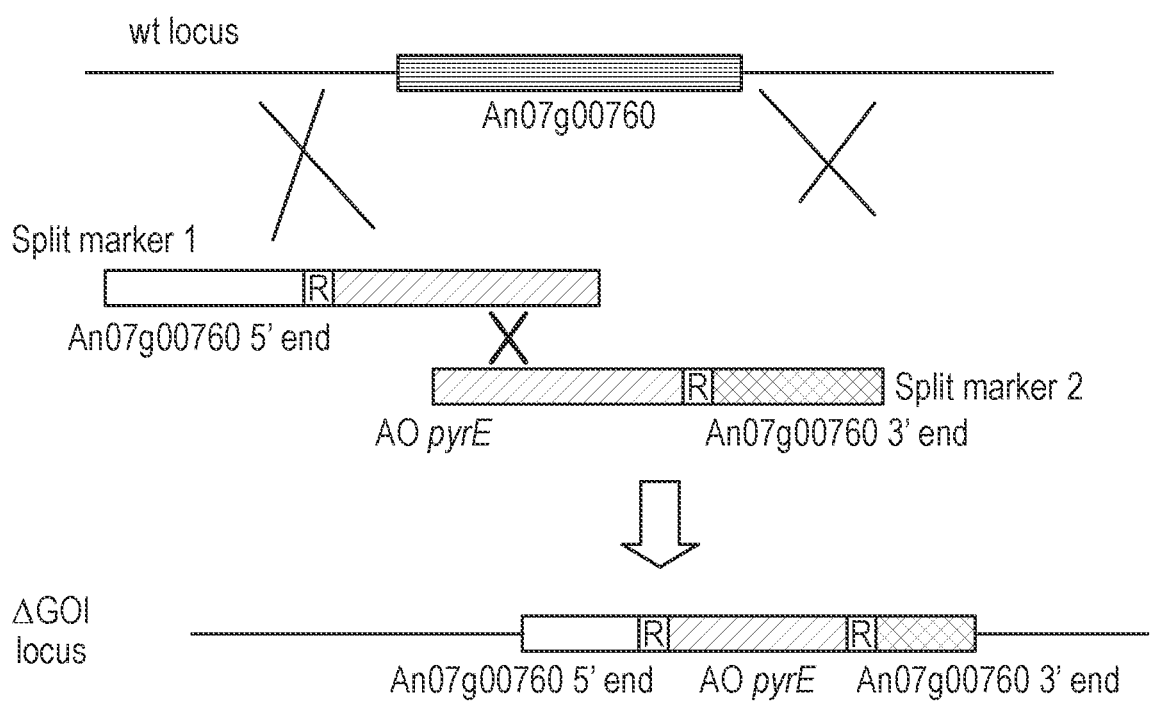
Figure 16B:
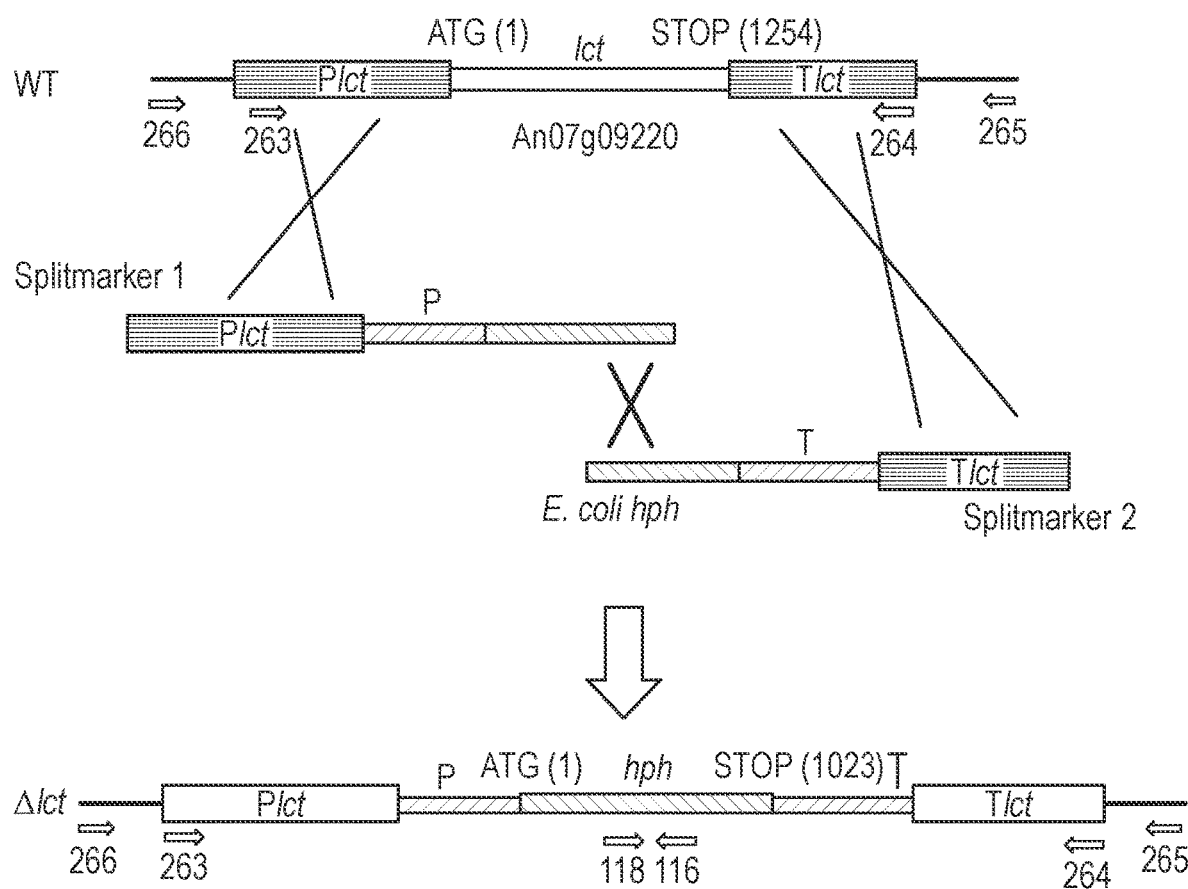
Figure 16C:
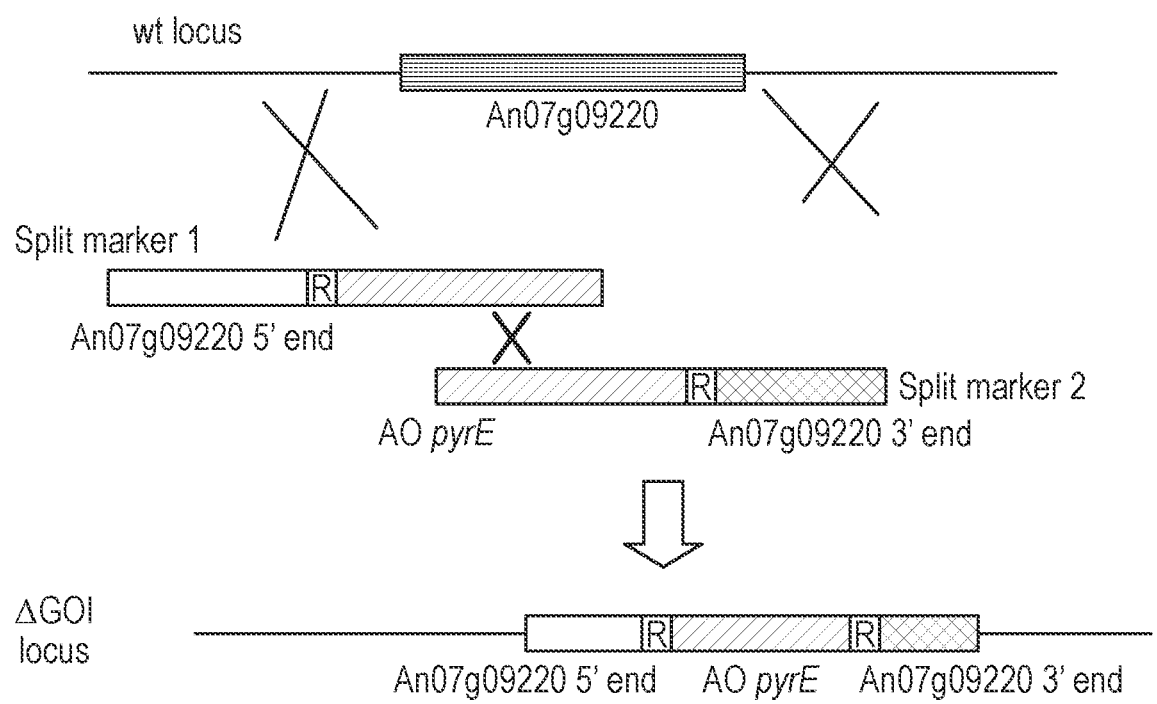
Figure 16D:
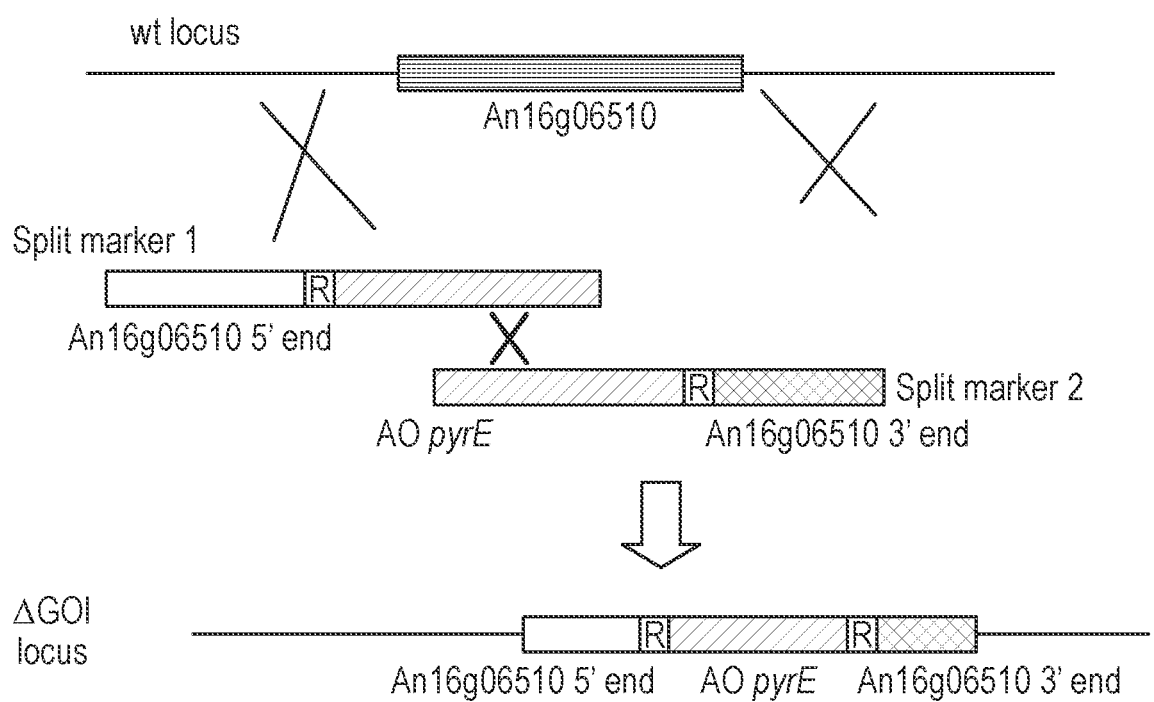

FIG. 10: Specific itaconic acid production in IA resistant *A. niger* strains. Shakeflasks were filled with production medium. Evolution experiment mutant strains EE #25 (CBS 141661), EE #26 (CBS 141662) and their parental strain CitB #99 (CBS 141659) were used in this experiment. Specific itaconic acid production expressed in g/g biomass after 5 days of incubation at 33° C. is given.

FIG. 11: Blast results for itaconyl-CoA transferase.

FIG. 12: Blast results for itaconyl-CoA hydratase (citramalyl-CoA hydro-lyase).

FIG. 13: Blast results with citramalyl-CoA lyase.

FIG. 14: Blast results with trans-aconitate 2-methyltransferase.

FIG. 15: Blast results with alternative itaconic acid pathway genes trans-aconitase decarboxylase (A) and aconitate isomerase (B).

FIG. 16: (A) Splitmarker design for gene An07g00760 (itaconyl-CoA transferase) using the *A. oryzae* pyrE selection marker flanked by direct repeat sequences. (B) Splitmarker design for gene An07g00760 (itaconyl-CoA transferase) using the *E. coli* hygromycin B phosphotransferase (hph) selection marker. (C) Splitmarker design for gene An07g09220 (itaconyl-CoA hydratase) using the *A. oryzae* pyrE selection marker flanked by direct repeat sequences. (D) Splitmarker design for gene An16g06510 (trans-aconitate 2-methyltransferase) using the *A. oryzae* pyrE selection marker flanked by direct repeat sequences.

Figure 17A:
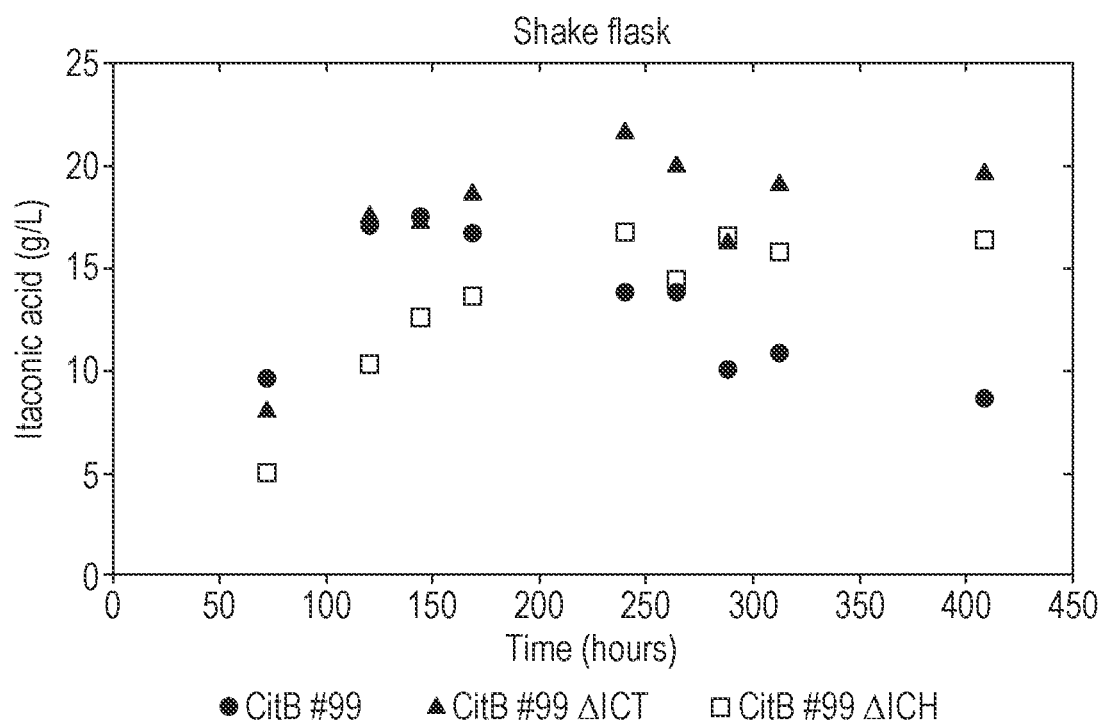

FIG. 17: Improved itaconic acid production in modified IA producing *A. niger* strains grown in flasks. Erlenmeyer flasks were filled with production medium. Deletion mutants CitB #99 ΔICT #RD1 (CBS 143055), CitB #99 ΔICH #RB2 (CBS 143056) and their parental strain CitB #99 (CBS 141659) were used in this experiment. Flasks were incubated at 33° C. and (A) put to shake (250 RPM) or (B) left static. Itaconic acid levels (g/l) were obtained in time.

Figure 18:
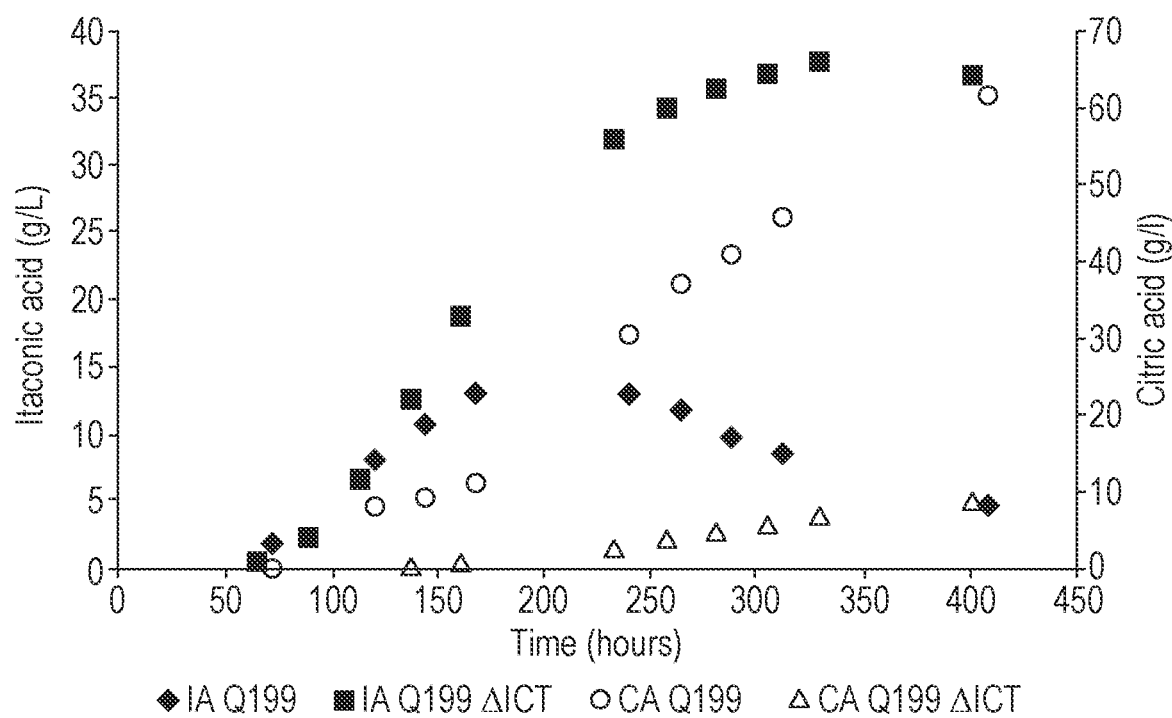

FIG. 18: Improved itaconic acid production in a modified IA producing *A. niger* strain, derived from an industrial citric acid production strain, grown in flasks. Erlenmeyer flasks were filled with production medium. Deletion mutants Q199 ΔICT #4 (CBS 143050) and its parental strain Q199 (CBS 143051) were used in this experiment. Shakeflasks were incubated at 35° C. at 250 RPM and itaconic acid levels (g/l) were obtained in time.

Figure 19A:
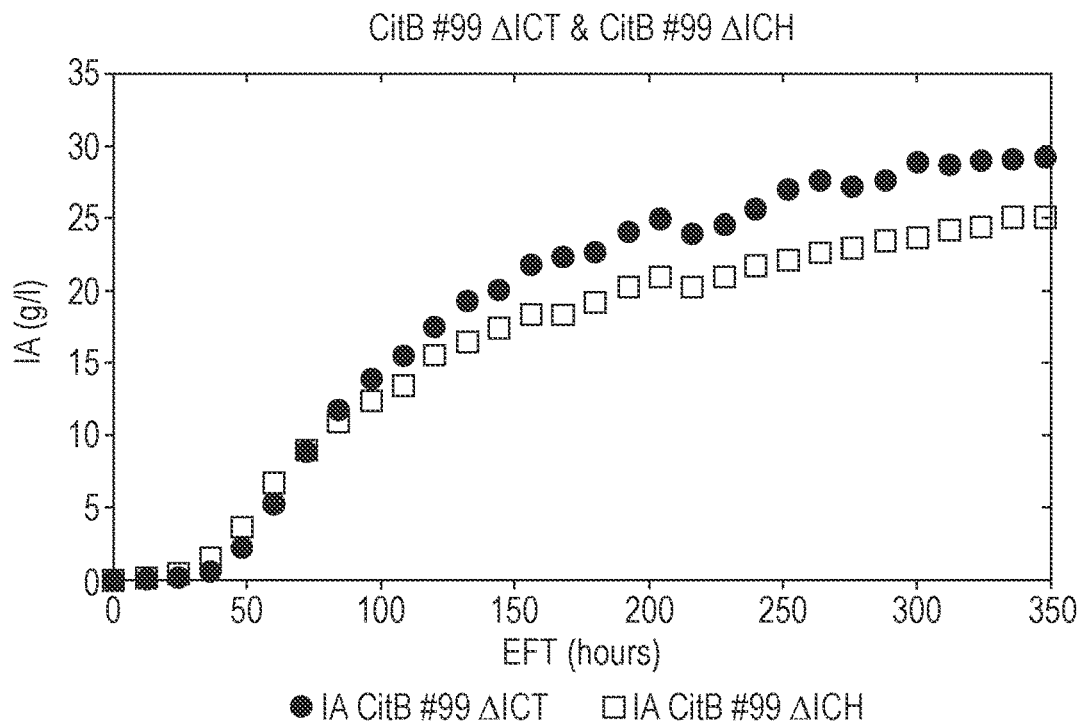
Figure 19B:
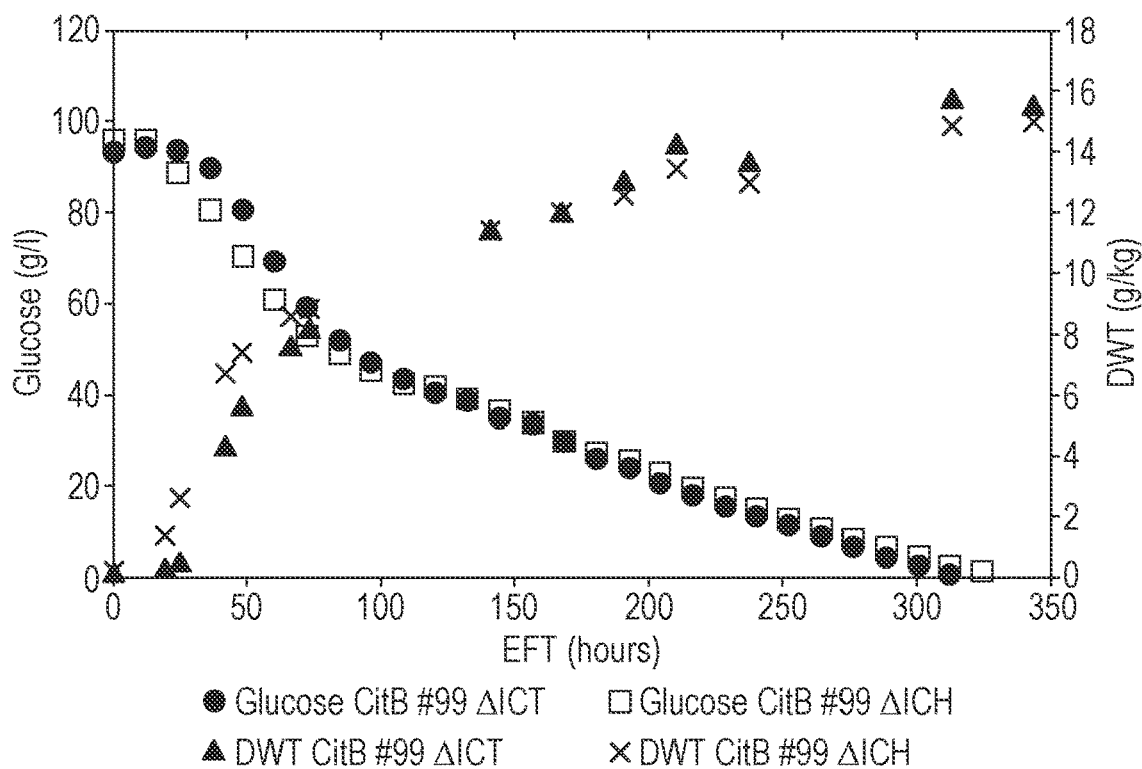

FIG. 19: Controlled fermentation of modified IA producing *A. niger* strains CitB #99 ΔICT #RD1 (CBS 143055) and CitB #99 ΔICH #RB2 (CBS 143056) showing improved production and no degradation of itaconic acid. A. itaconic acid (IA) titer (g/l) and B. glucose concentration (g/l), and biomass (g DWT/kg) are shown in relation to fermentation time EFT (h).

Figure 20:
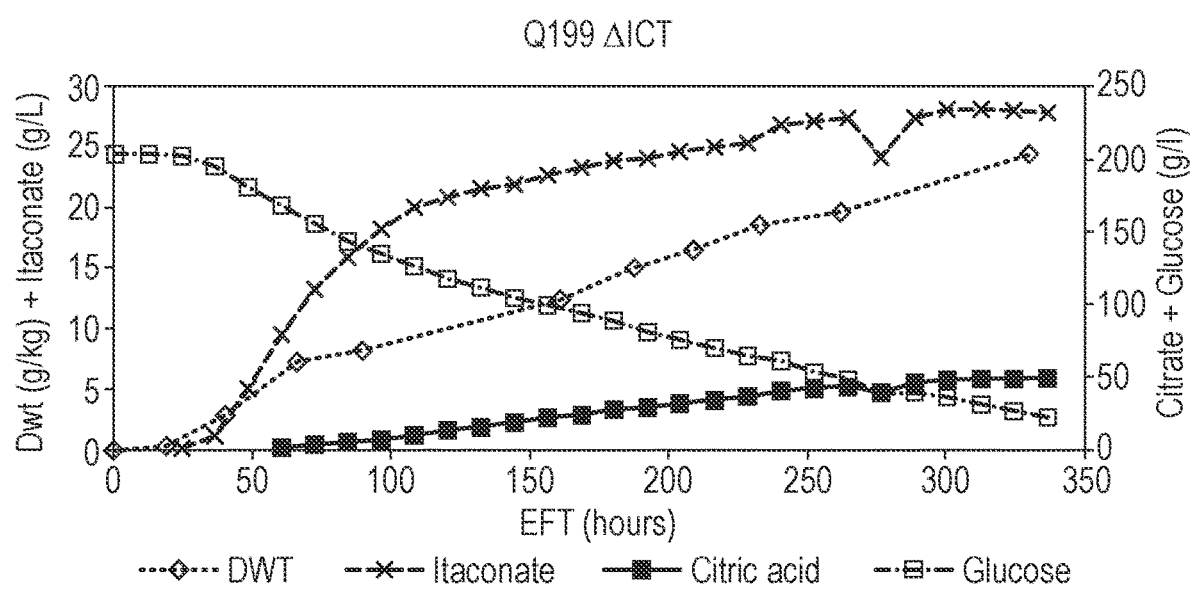

FIG. 20: Controlled fermentation of Q199 ΔICT #4 (CBS 143050), a modified IA producing *A. niger* strain, derived from an industrial citric acid production strain, showing production and no degradation of itaconic acid. Itaconate titer (g/l), citrate titer (g/l), glucose concentration (g/l), and biomass (g DWT/kg) are shown in relation to fermentation time EFT (hours).

FIG. 21: Postulated biosynthesis and catabolism route(s) for itaconic acid in *A. terreus*. 1, citrate synthase A; 2, aconitase; 3, cis-aconitic acid decarboxylase (itaconate-forming); 4, cis-aconitic acid decarboxylase (citraconate-forming); 5, citraconate isomerase; 6, mitochondrial dicarboxylate-tricarboxylate antiporter; 7, mitochondrial tricarboxylate transporter; 8, dicarboxylate transporter; 9, 2-methylcitrate dehydratase; 10, citrate synthase B; 11, itaconyl-CoA transferase; 12, itaconyl-CoA hydratase; 13, citramalyl-CoA lyase; 14, trans-aconitate 2-methyltransferase.

Figure 22:
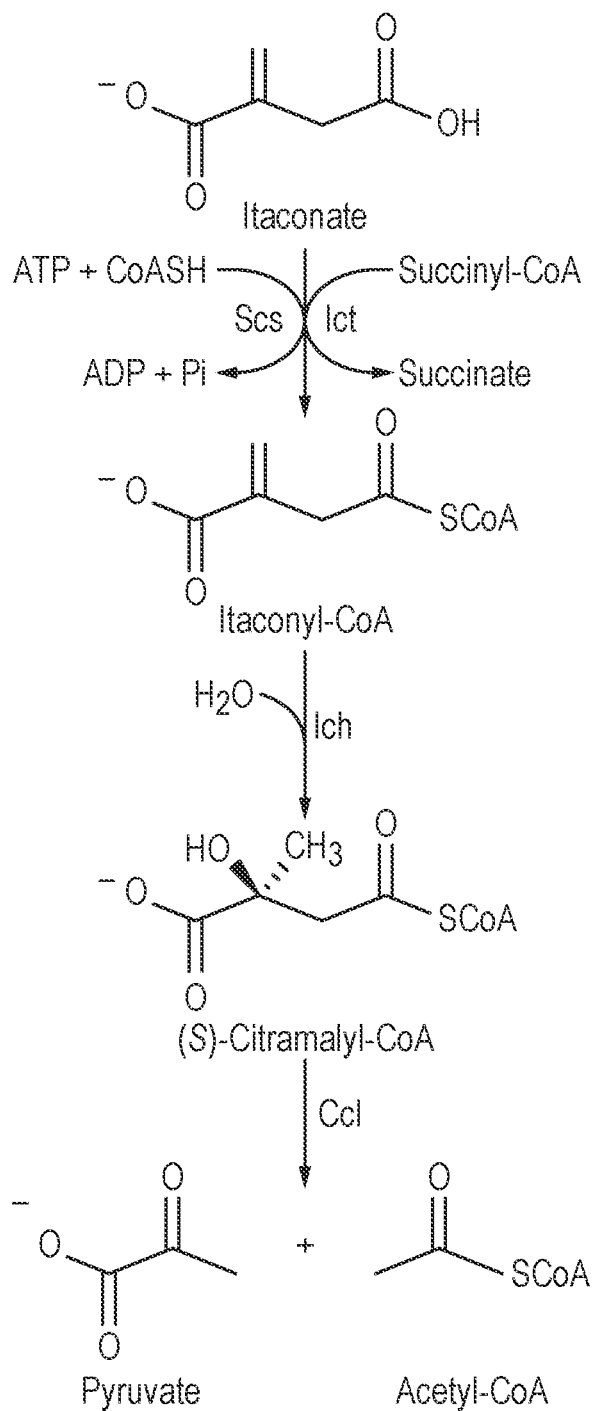

FIG. 22. Itaconic acid degradation pathway (adapted from Sasikaran et al., 2014, Nat. Chem. Biol. 10:371-377).

DETAILED DESCRIPTION OF THE INVENTION

"Fungi" are herein defined as eukaryotic micro-organisms and include all species of the subdivision Eumycotina (Alexopoulos, C. J., 1962, In: Introductory Mycology, John Wiley & Sons, Inc., New York). The term fungus thus includes both filamentous fungi and yeast. "Filamentous fungi" are herein defined as eukaryotic micro-organisms that include all filamentous forms of the subdivision Eumycotina. These fungi are characterized by a vegetative mycelium composed of chitin, cellulose, and other complex polysaccharides. The filamentous fungi used in the present invention are morphologically, physiologically, and genetically distinct from yeasts. Vegetative growth by filamentous fungi is by hyphal elongation and carbon catabolism of most filamentous fungi are obligately aerobic. "Yeasts" are herein defined as eukaryotic micro-organisms and include all species of the subdivision Eumycotina that predominantly grow in unicellular form. Yeasts may either grow by budding of a unicellular thallus or may grow by fission of the organism.

The term "fungal", when referring to a protein or nucleic acid molecule thus means a protein or nucleic acid whose amino acid or nucleotide sequence, respectively, naturally occurs in a fungus.

The term "gene", as used herein, refers to a nucleic acid sequence containing a template for a nucleic acid polymerase, in eukaryotes, RNA polymerase II. Genes are transcribed into mRNAs that are then translated into protein.

"Expression" refers to the transcription of a gene into structural RNA (rRNA, tRNA) or messenger RNA (mRNA) with subsequent translation into a protein.

The term "inhibition" can be both used for inhibition of expression of a protein or for inhibition of function of a protein. When used in conjunction with protein expression the term "inhibition" refers to a measurable reduction in expression of mRNA encoding said protein or in the concentration of the protein in the cell. The reduction can be anything from less than normal to zero (i.e. no mRNA or protein measurable). Further, with respect to protein function, the term "inhibition" refers to any action and/or treatment which operates against the full activity of a protein thus reducing and/or completely suppressing protein function.

The term "vector" as used herein, includes reference to an autosomal expression vector and to an integration vector used for integration into the chromosome.

The term "expression vector" refers to a DNA molecule, linear or circular, that comprises a segment encoding a polypeptide of interest under the control of (i.e., operably linked to) additional nucleic acid segments that provide for its transcription. Such additional segments may include promoter and terminator sequences, and may optionally include one or more origins of replication, one or more selectable markers, an enhancer, a polyadenylation signal, and the like. Expression vectors are generally derived from plasmid or viral DNA, or may contain elements of both. In particular an expression vector comprises a nucleotide sequence that comprises in the 5' to 3' direction and operably linked: (a) a fungal-recognized transcription and translation initiation region, (b) a coding sequence for a polypeptide of interest, and (c) a fungal-recognized transcription and translation termination region. "Plasmid" refers to autonomously replicating extrachromosomal DNA which is not integrated into a microorganism's genome and is usually circular in nature.

An "integration vector" refers to a DNA molecule, linear or circular, that can be incorporated in a microorganism's genome and provides for stable inheritance of a gene encoding a polypeptide of interest. The integration vector generally comprises one or more segments comprising a gene sequence encoding a polyp eptide of interest under the control of (i.e., operably linked to) additional nucleic acid segments that provide for its transcription. Such additional segments may include promoter and terminator sequences, and one or more segments that drive the incorporation of the gene of interest into the genome of the target cell, usually by the process of homologous recombination. Typically, the integration vector will be one which can be transferred into the host cell, but which has a replicon that is non-functional in that organism. Integration of the segment comprising the gene of interest may be selected if an appropriate marker is included within that segment.

"Transformation" and "transforming", as used herein, refer to the insertion of an exogenous polynucleotide into a host cell, irrespective of the method used for the insertion, for example, direct uptake, transduction, f-mating or electroporation. The exogenous polynucleotide may be maintained as a non-integrated vector, for example, a plasmid, or alternatively, may be integrated into the host cell genome.

By "host cell" is meant a cell that contains a vector or recombinant nucleic acid molecule and supports the replication and/or expression of the vector or recombinant nucleic acid molecule. Host cells may be prokaryotic cells such as *E. coli*, or eukaryotic cells such as yeast, fungus, plant, insect, amphibian, or mammalian cells. Preferably, host cells are fungal cells.

Key in the biosynthetic pathway for itaconic acid is the localisation of the various substrates. It is thought that production of itaconic acid mainly occurs in the cytosol, but part of the production takes place in the mitochondrion. There is also an active transport of itaconic acid (or other compounds in the metabolic route in which itaconic acid is formed) in between the mitochondrion and the cytoplasma. In many biochemical pathways, the end-product is inhibiting its own production to prevent excess end-product in the biological system. Excess end-product will not only lead to loss of energy in an economical sense, it can also give rise to unwanted side effects such as toxicity. It is contemplated that by depleting the cell of itaconic acid the formation of new itaconic acid will continue without end-product inhibition and without any inhibitions caused by the toxicity of the itaconate, thus giving—in total—an increase yield of itaconic acid. Inhibition by IA toxicity can also be relieved by selection of IA resistant mutants.

The enzymes itaconyl-CoA transferase, itaconyl-CoA hydratase (citramalyl-CoA hydro-lyase) and citramalyl-CoA lyase (EC 4.1.3.25) are the most important enzymes in the catabolism of itaconic acid (see FIG. 21), and they degrade itaconic acid via itaconyl-CoA into citramalyl-CoA, which is further degraded by citramalyl-CoA pyruvate lyase into acetyl-CoA and pyruvate.

The present invention discloses that inhibition of one or more of these enzymes prevents growth inhibition by toxic effects of itaconic acid and inhibits degradation or biochemical conversion of itaconic acid or its precursors and would be advantageously used for overproduction of itaconic acid in micro-organisms which are capable of producing itaconic acid. Inhibition of the enzyme(s) can take place by various mechanisms, which are shortly discussed below.

In principle, inhibition of the first step in the degradation of itaconic acid (i.e. the enzyme itaconyl-CoA transferase) would already be sufficient to block the degradation of itaconic acid. It is however advantageous to also block the second step, the conversion by the enzyme itaconyl-CoA hydratase (citramalyl-CoA hydro-lyase), if only as a precautious safety measure. Blocking this second step has additional benefits as the absence of this second step may downregulate the entire degradation pathway and/or it may avoid the production of toxic intermediates originating from the second step.

Next to these two enzymes, it would also be possible to (additionally) block the enzyme citramalyl-CoA pyruvate lyase.

Additional inhibition of this enzyme in organisms in which such an enzyme is active would further increase the production of itaconic acid.

It is believed that any method which results in an inhibition of the degradation or biochemical conversion of itaconic acid by inhibiting the above-mentioned enzymes, whether said inhibition is on the translational, transcriptional, post-transcriptional or functional level, would give the desired effect.

The enzyme(s) preferably is/are inhibited by inhibition on transcriptional or translational level, e.g. by mutation, antisense inhibition or by RNA interference (RNAi). Mutation of the gene coding for the enzyme can be accomplished by site-directed mutagenesis with a mutated nucleotide sequence, which causes aberrant expression of the enzyme or expression of an aberrant enzyme. Such a mutation can comprise, but is not limited to, the following examples:

1) a change in the promoter sequence of the gene, thereby decreasing promoter function. The promoter is usually situated upstream (5') of the coding sequence. In its broader scope, the term "promoter" includes the RNA polymerase binding site as well as regulatory sequence elements located within several hundreds of base pairs, occasionally even further away, from the transcription start site. Such regulatory sequences are, e.g., sequences that are involved in the binding of protein factors that control the effectiveness of transcription initiation in response to physiological conditions. A change in the promoter sequence can be accomplished by, for instance, deletion of the ribosome binding site or by deletion of the TATA-box, which causes loss of recognition or binding of the polymerase enzyme and thus an inhibited formation of mRNA. Alternatively, the promoter can be shortened, or even deleted totally, or replaced by a promoter which is inducible. In the latter case, enzyme product will only be formed after induction of the promoter. Inducible promoters are known to the person skilled in the art. Typically, the factor that binds specifically to an inducible promoter to activate transcription is present in an inactive form which is then directly or indirectly converted to the active form by the inducer. The inducer may be a chemical agent such as a protein, metabolite (sugar, alcohol, etc.), a growth regulator, herbicide, or a phenolic compound or a physiological stress imposed directly by heat, salt, wounding, toxic elements etc., or indirectly through the action of a pathogen or disease agent such as a virus. A cell containing an inducible promoter may be exposed to an inducer by externally applying the inducer to the cell such as by spraying, heating, or similar methods. Inducible promoters are known to those familiar with the art and several exist that could conceivably be used to inhibit expression of the enzyme. Inducible promoters suitable for use in accordance with the present invention include, but are not limited to, the heat shock promoter, promoters inducible by the mammalian steroid receptor system and any chemically inducible promoter. Examples of inducible promoters include the inducible 70 kD heat shock promoter of *Drosophila melanogaster* (Wing et al 1989, Mol Gen Genet, 219: 9-16) and the alcohol dehydrogenase promoter which is induced by ethanol. A promoter that is inducible by a simple chemical is particularly useful. Such simple or common chemicals are used in the induction of so-called gene switch promoters. Examples of gene switch promoters include the alcA/alcR gene switch promoter as described in published International Patent Application No. WO 93/21334; the GST promoter, as described in published International Patent Application Nos. WO 90/08826 and WO 93/031294; and the ecdysone switch system as described in published International Patent Application No. WO 96/37609. In such switch systems, the timing of gene expression is controlled by application of an external chemical. The switch chemical may be applied as a spray or vapor to all or part of the transgenic plant or as a root drench. Examples of suitable switch chemicals are provided in the above references describing switch promoter systems. The external chemical stimulus is preferably an chemical, the use of which is not detrimental to the microbial cells. Inducible switch promoter systems preferably include one or two component systems; nevertheless, systems comprising more than two components are encompassed by the present invention. The alcA/alcR switch promoter system is particularly preferred. In the alcA/alcR promoter switch system, the preferred chemical inducer is ethanol, in either liquid or vapour form. One of the main advantages of the use of ethanol is that small quantities of ethanol generate high levels of expression. The alcA/alcR inducible promoter system is a two-component system involving DNA sequences coding for the alcA promoter and the alcR protein, the expression of which is placed under the control of desired promoters. The alcR protein activates the alcA promoter in the presence of an inducer and any gene under the control of the alcA promoter (in this case the gene coding for the enzyme), will therefore be expressed only in the presence of that inducer. With such a system the activity of the gene construct can be limited both by place and by time. Other gene-switch systems and/or inducible promoters are known in the art and would also be equally applicable. An advantage in using such an inducible promoter or gene-switch system is that it may be possible that expression of the enzyme is desired during certain moments of growth of the culture. In that case, during these times, the inducer can be introduced into the culture, resulting in expression of the enzyme. At other moments, no inducer is present and accumulation of itaconic acid will take place.

2) a change in the coding sequence. Such a change can be effected by the insertion, deletion or change of one of more nucleotides in the open reading frame of the gene coding for the itaconyl-CoA transferase and/or itaconyl-CoA hydratase (citramalyl-CoA hydro-lyase) and/or citramalyl-CoA lyase enzyme. Such a change should be able to cause a change in the amino acid sequence of the transcribed enzyme. A preferred change-type is causing a frame-shift mutation by inserting or deleting one or two nucleotides. Such a mutation would distort the three-nucleotide codon based information and would cause construction of a completely different sequence of amino acids from the mutation point until a stop codon would be encountered. Generally, such a frame-shift mutation (especially where the mutation is near the 5' end of the gene) yields proteins which do no longer have the biological function of the enzyme encoded by the original gene. Alternatively, a stop codon can be inserted in the gene, which causes termination of the production of the amino acid sequence at that point, which thus results in the production of N-terminally truncated proteins. Also in this case, when the mutation is located near the 5' end of the gene, the resulting truncated protein will no longer have any biologic functionality.

3) introduction of a protein binding site. The insertion of a protein binding site will cause attachment of the corresponding protein (if present), thereby introducing steric hindrance for transcription of the gene. Preferably such a binding site is introduced in front of or in the neighborhood of the start codon (either in the promoter sequence or in the coding sequence) and the presence of an attached protein will hinder the polymerase to start or continue transcription. This again enables a regulatable system, whereby the amount of transcription can be regulated by the amount of protein that is available for binding. Preferred binding sites for such a system are those specific for the transcriptional repressor protein CreA relevant for carbon-catabolite-repression in *Aspergillus* species (Mathieu, M. et al., 2005, Mol. Microbiol. 56(2):535-548; Felenbok, B. et al., 2001, Prog. Nucleic Acid Res. Mol. Biol. 69:149-204; Mathieu, M. and Felenbok, B., 1994, EMBO J. 13(17):4022-4027).

4) a change in gene splicing. A eukaryotic gene typically is present in a structure in which parts having a coding sequence (called 'exons') are interspersed with parts having a non-coding sequence ('introns'). For a correct expression of the eukaryotic gene the whole gene is transcribed into (pre-)mRNA, but then the introns are spliced out of the RNA to result in a final mRNA only having coding sequences (and some regulatory sequences, such as a poly-A tail).

It is also known in especially in various diseases alternative RNA transcripts can be produced from the same genomic region of DNA. These alternative transcripts are generally known as "variants." More specifically, "pre-mRNA variants" are transcripts produced from the same genomic DNA that differ from other transcripts produced from the same genomic DNA in either their start or stop position and contain both intronic and exonic sequence. Upon excision of one or more exon or intron regions, or portions thereof during splicing, pre-mRNA variants produce smaller "mRNA variants." Consequently, mRNA variants are processed pre-mRNA variants and each unique pre-mRNA variant must always produce a unique mRNA variant as a result of splicing. These mRNA variants are also known as "alternative splice variants." If no splicing of the pre-mRNA variant occurs then the pre-mRNA variant is identical to the mRNA variant.

It is also known in nature such variants can be produced through the use of alternative signals to start or stop transcription and that pre-mRNAs and mRNAs can possess more than one start codon or stop codon. Variants that originate from a pre-mRNA or mRNA that use alternative start codons are known as "alternative start variants" of that pre-mRNA or mRNA. Those transcripts that use an alternative stop codon are known as "alternative stop variants" of that pre-mRNA or mRNA. One specific type of alternative stop variant is the "polyA variant" in which the multiple transcripts produced result from the alternative selection of one of the "polyA stop signals" by the transcription machinery, thereby producing transcripts that terminate at unique polyA sites.

As used herein, "antisense mechanisms" are all those involving hybridization of a compound with target nucleic acid, wherein the outcome or effect of the hybridization is either target degradation or target occupancy with concomitant stalling of the cellular machinery involving, for example, transcription or splicing.

As used herein, the terms "precursor mRNA" or "pre-mRNA" refer to an immature single strand of messenger ribonucleic acid (mRNA) that contains one or more intervening sequence(s) (introns). Pre-mRNA is transcribed by an RNA polymerase from a DNA template in the cell nucleus and is comprised of alternating sequences of introns and coding regions (exons). Once a pre-mRNA has been completely processed by the splicing out of introns and joining of exons, it is referred to as "messenger RNA" or "mRNA," which is an RNA that is completely devoid of intron sequences. Eukaryotic pre-mRNAs exist only transiently before being fully processed into mRNA. When a pre-mRNA has been properly processed to an mRNA sequence, it is exported out of the nucleus and eventually translated into a protein by ribosomes in the cytoplasm.

As used herein, the terms "splicing" and "(pre-)mRNA processing" refer to the modification of a pre-mRNA following transcription, in which introns are removed and exons are joined. Pre-mRNA splicing involves two sequential biochemical reactions. Both reactions involve the spliceosomal transesterification between RNA nucleotides. In a first reaction, the 2'-OH of a specific branch-point nucleotide within an intron, which is defined during spliceosome assembly, performs a nucleophilic attack on the first nucleotide of the intron at the 5' splice site forming a lariat intermediate. In a second reaction, the 3'-OH of the released 5' exon performs a nucleophilic attack at the last nucleotide of the intron at the 3' splice site thus joining the exons and releasing the intron lariat. Pre-mRNA splicing is regulated by intronic silencer sequence (ISS), exonic silencer sequences (ESS) and terminal stem loop (TSL) sequences.

As used herein, "modulation of splicing" refers to altering the processing of a pre-mRNA transcript such that there is an increase or decrease of one or more splice products, or a change in the ratio of two or more splice products. Modulation of splicing can also refer to altering the processing of a pre-mRNA transcript such that a spliced mRNA molecule contains either a different combination of exons as a result of exon skipping or exon inclusion, a deletion in one or more exons, or additional sequence not normally found in the spliced mRNA (e.g., intron sequence).

As used herein, "splice site" refers to the junction between an exon and an intron in a pre-mRNA (unspliced RNA) molecule (also known as a "splice junction"). A "cryptic splice site" is a splice site that is not typically used but may be used when the usual splice site is blocked or unavailable or when a mutation causes a normally dormant site to become an active splice site. An "aberrant splice site" is a splice site that results from a mutation in the native DNA and pre-mRNA.

Changing the splicing of a gene and thereby producing expression products that are not or only partial functional may be achieved by blocking the splice sites that are needed for a proper expression of the gene. Changing of the splicing may be effected by introducing antisense oligomeric compounds, generally oligonucleotides or oligonucleotide analogs or mimetics, that are capable of interacting with and/or hybridizing to a pre-mRNA thereby modifying gene expression and/or splicing. Oligomeric compounds can be introduced in the form of single-stranded, double-stranded, circular, branched or hairpins and can contain structural elements such as internal or terminal bulges or loops. Oligomeric double-stranded compounds can be two strands hybridized to form double-stranded compounds or a single strand with sufficient self complementarity to allow for hybridization and formation of a fully or partially double-stranded compound. Enzyme-dependent antisense oligonucleotides include forms that are dependent on RNase H activity to degrade target mRNA, and include single-stranded DNA, RNA, and phosphorothioate antisense. Steric blocking antisense oligonucleotides (RNase-H independent antisense) interfere with gene expression or other mRNA-dependent cellular processes by binding to a target sequence of mRNA. Steric blocking antisense includes 2'-0 alkyl antisense oligonucleotides, morpholino antisense oligonucleotides, and tricyclo-DNA antisense oligonucleotides.

In the current invention blocking of splicing sites that cause splicing of intron 1 with the help of oligomeric compounds as defined above would lead to the expression of a non-functional protein.

Another embodiment for providing inhibition of the expression of the enzyme itaconyl-CoA transferase and/or citramalyl-CoA hydro-lyase (itaconyl-CoA hydratase) and/or citramalyl-CoA lyase is formed by silencing of the expression of the gene. Basically, three methods for silencing are known at this moment and are contemplated in this application: antisense expression, sense co-suppression and RNA-inhibition. However, the invention is not limited to these methods and any other method which causes silencing of the genes coding for the enzyme itaconyl-CoA transferase and/or citramalyl-CoA hydro-lyase (itaconyl-CoA hydratase) and/or citramalyl-CoA lyase is included.

For antisense expression, a nucleotide sequence coding for said gene, its homologue or variant, or at least a part thereof of 40 nucleotides or more, is put behind a suitable promoter in anti-sense direction. After transcription of this nucleotide sequence an mRNA is produced which is complementary to the mRNA formed through transcription of the endogenous female suppressor gene. It is well proven by now that production of such an anti-sense mRNA is capable of inhibition of the endogenous expression of the gene for which it is complementary. Furthermore, it has been proven that to achieve this effect even sequences with a less than 100% homology are useful. Also antisense mRNA's which are shorter than the endogenous mRNA which they should inhibit can be used. Generally, it is accepted that mRNA sequences of 23 nucleotides or more which have an identity of 70% or more will be capable of generating an inhibitory effect. The principal patent reference is EP 240,208 of Calgene Inc. There is no reason to doubt the operability of antisense technology. It is well-established, used routinely in laboratories around the world and products in which it is used are on the market.

The second approach is commonly called sense co-suppression. This phenomenon occurs when the gene or part of said gene is expressed in its sense direction. Although this kind of expression when full length genes are used most often results in overexpression of the gene, it has been found that in some cases and especially in cases when a sequence shorter than the full length sequence is used, expression of this gene or fragment causes inhibition of the endogenous gene. The principal patent reference on sense co-suppression is EP 465,572 in the name of DNA Plant Technology Inc.

Sense and antisense gene regulation is reviewed by Bird and Ray (Gen. Eng. Reviews 9: 207-221, 1991). Gene silencing can thus be obtained by inserting into the genome of a target organism an extra copy of the target female suppressor gene coding sequence which may comprise either the whole or part or be a truncated sequence and may be in sense or in antisense orientation. Additionally, intron sequences which are obtainable from the genomic gene sequence may be used in the construction of suppression vectors. There have also been reports of gene silencing being achieved within organisms of both the transgene and the endogenous gene where the only sequence identity is within the promoter regions.

The third possible way to silence genes is by using the so-called RNAi technology, which covers all applications in which double-stranded RNAs are used to achieve silencing of an endogenous gene. As has been demonstrated by Fire et al. (Nature, 391: 806-811, 1998) application of a dsRNA of which one strand is at least partly complementary to the endogenously produced mRNA whether produced intracellularly or added extracellularly is extremely capable of inhibiting translation of the mRNA into a protein. It is believed that this phenomenon works through the intermediate production of short stretches of dsRNA (with a length of 23 nucleotides). To achieve production of dsRNA a construct is made harboring both a sense and an antisense nucleotide sequence (together also called an inverted repeat) of at least 19, usually 23 nucleotides or more, of which one is complementary to the endogenous gene which needs to be silenced. The sense and antisense nucleotide sequences can be connected through a spacer nucleotide sequence of any length which allows for a fold back of the formed RNA so that a double stranded RNA is formed by the sense and antisense sequence. The spacer then serves to form the hairpin loop connecting both sense and antisense sequence. The order of the sense and antisense sequence is not important. It is also possible to combine more than one sense-antisense combination in one and the same construct. If the simple form is depicted as: prom—S—spac—AS—term, also the following constructs can be applied: prom—S1—spac—AS1—spac—S2—spac—AS2—term, or prom—S2—spac—51—spac—AS1—spac—AS2—term. Variations in the built up of the construct are possible, as long as the end product of the transcription of said constructs yields one or more dsRNAs. Alternatively, the double stranded structure may be formed by two separate constructs coding for complementary RNA strands, where RNA duplex formation occurs in the cell. In short notation these constructs then look like: prom1-S1-term1 and prom2-AS1-term2. Prom1 and prom2 can be the same or different but should both be constitutive or fruit-specific promoters, term1 and term2 can be the same or different. Both constructs can be introduced into the cell on the same vector, but can also be introduced using two different vectors.

RNA containing nucleotide sequences identical to a portion of the target female suppressor gene are preferred for inhibition. RNA sequences with insertions, deletions and single point mutations relative to the target sequence have also been found effective for inhibition. Thus, sequences with a sequence identity of less than 100% may be used. Sequence identity may be calculated by sequence comparison and alignment algorithms known in the art (see Gribskov and Devereux, Sequence Analysis Primer, Stockton Press, 1991, and references cited therein), for instance by using the Smith-Waterman algorithm as implemented in the BESTFIT software program using default parameters (e.g. University of Wisconsin Computing Group). Thus, the duplex region of the RNA may be defined functionally as a (double stranded) nucleotide sequence that is capable of hybridizing with a portion of the target gene transcript (e.g., 400 mM NaCl, 40 mM PIPES pH 6.4, 1 mM EDTA, 50° C. to 65° C. hybridization for 12-16 hours; followed by washing). The length of the identical nucleotide sequences should be at least 23 nucleotides, but preferably larger: 40, 50, 100, 200, 300 or 400 bases.

As disclosed herein, 100% sequence identity between the inhibiting construct and the target endogenous gene is not required to practice the present invention. Thus the invention has the advantage of being able to tolerate sequence variations that might be expected due to genetic mutation, strain polymorphism or evolutionary divergence.

Thus also included in the invention are constructs having a nucleotide sequence under control of a suitable promoter wherein said nucleotide sequence comprises a part of 40 or more nucleotides in a sense direction, or in an antisense direction or in an inverted repeat form, of the sequence of the gene coding for the enzyme itaconyl-CoA transferase and/or citramalyl-CoA hydro-lyase (itaconyl-CoA hydratase) and/or citramalyl-CoA lyase, or homologues or variants thereof.

Alternatively, transcription is prevented by means of the expression of a negatively acting transcription factor acting on the target gene promoter. Such negatively acting transcription factor can be natural or artificial. Artificial negatively acting transcription factors can be employed by the overexpression of an engineered polydactyl zinc-finger transcription factor coupled to a general transcription repressor. According to a further embodiment, the interfering with the target gene consists of destabilizing the target gene mRNA, in particular' by means of nucleic acid molecules that are complementary to the target gene mRNA selected from the group consisting of antisense RNA, RNAi molecules. Virus Induced Gene Silencing (VIGS) molecules, co-suppressor molecules, RNA oligonucleotides or DNA oligonucleotides.

In another embodiment the interfering with the target gene consists of inhibiting the target gene expression product. This can be achieved by means of the expression product(s) of one or more dominant negative nucleic acid constructs, overexpression of one or more suppressors which interact with the target gene product, or by means of one or more chemical compounds. Novel ways to introduce site-specific alterations in transcription of an (eukaryotic) gene is by a variation in the recently described CRISPR-Cas genetic engineering, homologous recombination system. (Cong L et al. Science 2013; 339: 819-823; *Mali* P et al. Science 2013; 339: 823-826; Cho S W et al. Nat Biotechnol 2013; 31: 230-232; Jinek M et al. Elife 2013; 2: e00471). This variation entails the use of a Cas enzyme that is defective in endonuclease activity, but which retains its ability, when co-expressed with a gRNA, to specifically interfere with transcriptional elongation, RNA polymerase binding or transcription factor binding. This system is also indicated as CRISPRi.(Qi L S et al. Cell 2013; 152: 1173-1183; Larson, M H et al 2013, Nature Protocols 8:2180-2196; Amelio, I. and Melino G., 2015, Cell Death & Differentiation, 22: 3-5).

The above-described systems are all systems that act on expression and do not change the underlying genetic sequence of the gene. In that respect these systems are also relatively easy to switch on or switch off at moments when suppression of expression is needed or when suppression of expression is no longer needed. Such a switch can e.g. advantageously be effected by putting the expression of one or all of the components of the silencing system under control of a specific time- or location-restrained promoter.

Next to changes in the expression of the gene, the gene itself may be changed in such a way that no longer a functional protein is expressed. This may be achieved by mutating the gene. The one or more mutations can be introduced randomly by means of one or more chemical compounds and/or physical means and/or by insertion of genetic elements. Suitable chemical compounds are ethyl methanesulfonate, nitrosomethylurea, hydroxylamine, proflavine, N-methyl-N-nitrosoguanidine, N-ethyl-N-nitrosourea, N-methyl-N-nitro" nitrosoguanidine, diethyl sulfate, ethylene imine, sodium azide, formaline, urethane, phenol and ethylene oxide, Physical means that can be used comprise UV-irradiation, fast-neutron exposures X-rays and gamma irradiation. The genetic element is a transposon, T-DNA, or retroviral element.

More efficient and targeted techniques are provided for by so-called site-directed mutagenesis techniques. Many systems for site-directed mutagenesis (SDM) are known to the skilled person, the most notorious being nuclease based SDM systems such as zinc finger nucleases, transcription activator-like effector nucleases (TALENs), and LAGLIDADG (SEQ ID NO:1) homing endonucleases (Curtin, S. J. et al., 2012, The Plant Genome 5:42-50). Another technology for SDM is based on homologous recombination with the target gene. Very recently, the above discussed CRISPR-Cas system has been proven very effective for SDM based on homologous recombination (see e.g. WO2014/144155).

In an embodiment, TALEN (Transcription Activator-like Effector Nuclease) protein or enzyme is used to disrupt or inactivate one or more genes of the itaconic acid degradation or biochemical conversion pathways of a cell. In such an embodiment, TALEN (Transcription Activator-like Effector Nuclease) protein or enzyme is used to disrupt or inactivate or mutate gene selected from the group comprising itaconyl-CoA transferase, itaconyl-CoA hydratase (citramalyl-CoA hydro-lyase) and/or citramalyl-CoA lyase. A TALEN protein is made of a DNA binding domain and a nuclease domain. The DNA binding domain also has 2 parts—the TAL domain that identifies sequences left to the double strand break (DSB) target is termed TAL-L and the TAL domain that identifies sequence right to the DSB target is termed TAL-R. Both TAL-L and TAL-R domains are expressed as fusion protein with the nuclease domain. The natural TAL effector proteins have two domains: an effector domain and a DNA-binding domain. The structure of the DNA-binding domain can be manipulated such that the domain binds specifically to any DNA sequence in the genome. These DNA-binding protein domains can be linked to a customized effector domain such as a nuclease, thus producing a chimeric TALEN (Transcription Activator-like Effector Nuclease) protein. The DNA-binding domain which provides DNA sequence specificity of TALE/TALEN, consists of a variable number of amino acid repeats. Each repeat contains 33-35 amino acids and recognizes a single DNA base pair. The DNA recognition occurs via 2 hypervariable amino acid residues at positions 12 and 13 within each repeat, called Repeat-Variable Di-Residues (RVDs), which are critical for recognizing specific DNA sequences. The RVDs of the repeats in TAL effectors can be varied to create a TAL protein that recognizes a specific target DNA sequence. RVD is specific to a simple cipher like, NI=A, HD=C, NG=T, NN=G or A (Boch, 2009; Moscou, 2009). N, I, H, D, and G represent one letter amino acid codes. The repeats of DNA binding domain are assembled in a TALE expression vector and co-expressed with a nuclease FokI endonuclease catalytic domain to create TALE nuclease (TALEN). Such TALENs, once expressed in the cell, bind sequence specifically and create a double stranded break which is repaired by Non Homologous End Joining (NHEJ). During such cellular processes, mutations, i.e. either deletions and/or insertions within the gene sequence render nonfunctional protein products.

Next to induced mutations also spontaneous mutations can occur that result in improved itaconic acid resistance and improved itaconic acid levels due to reduced degradation and or biochemical conversion. For the resistant mutants that are exemplified in the present application the exact nature of the mutation is not (yet) known, but the mutation is resided in one of the degradation or biochemical conversion pathways of itaconic acid.

"Clustered Regularly Interspaced Short Palindromic Repeats" and "CRISPRs", as used interchangeably herein refers to loci containing multiple short direct repeats that are found in the genomes of approximately 40% of sequenced bacteria and 90% of sequenced archaea. The CRISPR system is a microbial nuclease system involved in defense against invading phages and plasmids that provides a form of acquired immunity. The CRISPR loci in microbial hosts contain a combination of CRISPR-associated (Cas) genes as well as non-coding RNA elements capable of programming the specificity of the CRISPR-mediated nucleic acid cleavage. Short segments of foreign DNA, called spacers, are incorporated into the genome between CRISPR repeats, and serve as a 'memory' of past exposures. Cas9 forms a complex with the 3' end of the sgRNA, and the protein-RNA pair recognizes its genomic target by complementary base pairing between the 5' end of the sgRNA sequence and a predefined 20 bp DNA sequence, known as the protospacer. In nature this complex is directed to homologous loci of pathogen DNA via regions encoded within the crRNA, i.e., the protospacers, and protospacer-adjacent motifs (PAMs) within the pathogen genome. The non-coding CRISPR array is transcribed and cleaved within direct repeats into short crRNAs containing individual spacer sequences, which direct Cas nucleases to the target site (protospacer). By simply exchanging the 20 bp recognition sequence of the expressed sgRNA, the Cas9 nuclease can be directed to new genomic targets. CRISPR spacers are used to recognize and silence exogenous genetic elements in a manner analogous to RNAi in eukaryotic organisms.

Three classes of CRISPR systems (Types I, II and III effector systems) are known. The Type II effector system carries out a targeted DNA double-strand break in four sequential steps, using a single effector enzyme, Cas9, to cleave dsDNA. Compared to the Type I and Type III effector systems, which require multiple distinct effectors acting as a complex, the Type II effector system may function in alternative contexts such as eukaryotic cells. The Type II effector system consists of a long pre-crRNA, which is transcribed from the spacer-containing CRISPR locus, the Cas9 protein, and a tracrRNA, which is involved in pre-crRNA processing. The tracrRNAs hybridize to the repeat regions separating the spacers of the pre-crRNA, thus initiating dsRNA cleavage by endogenous RNase III. This cleavage is followed by a second cleavage event within each spacer by Cas9, producing mature crRNAs that remain associated with the tracrRNA and Cas9, forming a Cas9: crRNA-tracrRNA complex.

The Cas9:crRNA-tracrRNA complex unwinds the DNA duplex and searches for sequences matching the crRNA to cleave. Target recognition occurs upon detection of complementarity between a "protospacer" sequence in the target DNA and the remaining spacer sequence in the crRNA. Cas9 mediates cleavage of target DNA if a correct protospacer-adjacent motif (PAM) is also present at the 3' end of the protospacer. For protospacer targeting, the sequence must be immediately followed by the protospacer-adjacent motif (PAM), a short sequence recognized by the Cas9 nuclease that is required for DNA cleavage. Different Type II systems have differing PAM requirements. The *S. pyogenes* CRISPR system may have the PAM sequence for this Cas9 (SpCas9) as 5'-NRG-3', where R is either A or G, and characterized the specificity of this system in human cells. A unique capability of the CRISPR/Cas9 system is the straightforward ability to simultaneously target multiple distinct genomic loci by co-expressing a single Cas9 protein with two or more sgRNAs. For example, the *Streptococcus pyogenes* Type II system naturally prefers to use an "NOG" sequence, where "N" can be any nucleotide, but also accepts other PAM sequences, such as "NAG" in engineered systems (Hsu et al, Nature Biotechnology (2013) doi: 10.1038/nbt.2647). Similarly, the Cas9 derived from *Neisseria meningitidis* (NmCas9) normally has a native PAM of NNNNGATT, but has activity across a variety of PAMs, including a highly degenerate NNNNGNNN PAM (Esvelt et al. Nature Methods (2013) doi: 10.1038/nmeth.2681).

An engineered form of the Type II effector system of *Streptococcus pyogenes* was shown to function in eukaryotic cells for genome engineering. In this system, the Cas9 protein was directed to genomic target sites by a synthetically reconstituted "guide RNA" ("gRNA", also used interchangeably herein as a chimeric single guide RNA ("sgRNA")), which is a crRNA-tracrRNA fusion that obviates the need for RNase III and crRNA processing in general.

In the present invention CRISPR/Cas9-based engineered systems may be used in genome editing of the target organism. The CRISPR/Cas9-based engineered systems may be designed to target any gene, but for the use in the present invention especially a gene selected from the group consisting of itaconyl-CoA transferase, itaconyl-CoA hydratase (citramalyl-CoA hydro-lyase) and/or citramalyl-CoA lyase. The CRISPR/Cas9-based systems may include a Cas9 protein or Cas9 fusion protein and at least one gRNA. The Cas9 fusion protein may, for example, include a domain that has a different activity that what is endogenous to Cas9, such as a transactivation domain.

The CRISPR/Cas9-based system may include a Cas9 protein or a Cas9 fusion protein. Cas9 protein is an endonuclease that cleaves nucleic acid and is encoded by the CRISPR loci and is involved in the Type II CRISPR system. The Cas9 protein may be from any bacterial or archaea species, such as *Streptococcus pyogenes*. The Cas9 protein may be mutated so that the nuclease activity is inactivated. An inactivated Cas9 protein from *Streptococcus pyogenes* (iCas9, also referred to as "dCas9") with no endonuclease activity has been recently targeted to genes in bacteria, yeast, and human cells by gRNAs to silence gene expression through steric hindrance. As used herein, "iCas9" and "dCas9" both refer to a Cas9 protein that has the amino acid substitutions D10A and H840A and has its nuclease activity inactivated. The CRISPR/Cas9-based system may alternatively include a Cas fusion protein. The fusion protein may comprise two heterologous polypeptide domains, wherein the first polypeptide domain comprises a Cas protein and the second polypeptide domain has nuclease activity that is different from the nuclease activity of the Cas9 protein. The fusion protein may include a Cas9 protein or a mutated Cas9 protein, as described above, fused to a second polypeptide domain that has nuclease activity. A nuclease, or a protein having nuclease activity, is an enzyme capable of cleaving the phosphodiester bonds between the nucleotide subunits of nucleic acids. Nucleases are usually further divided into endonucleases and exonucleases, although some of the enzymes may fall in both categories. Well known nucleases are deoxyribonuclease and ribonuclease.

The gRNA provides the targeting of the CRISPR/Cas9-based system. The gRNA is a fusion of two noncoding RNAs: a crRNA and a tracrRNA. The sgRNA may target any desired DNA sequence by exchanging the sequence encoding a 20 bp protospacer which confers targeting specificity through complementary base pairing with the desired DNA target. gRNA mimics the naturally occurring crRNA: tracrRNA duplex involved in the Type II effector system. This duplex, which may include, for example, a 42-nucleotide crRNA and a 75-nucleotide tracrRNA, acts as a guide for the Cas9 to cleave the target nucleic acid. The "target region", "target sequence" or "protospacer" as used interchangeably herein refers to the region of the target gene to which the CRISPR/Cas9-based system targets. In the present invention this would be a target region in a gene selected from the group consisting of itaconyl-CoA transferase, itaconyl-CoA hydratase (citramalyl-CoA hydro-lyase) and/or citramalyl-CoA lyase. The CRISPR/Cas9-based system may include at least one gRNA, wherein the gRNAs target different DNA sequences. The target DNA sequences may be overlapping. The target sequence or protospacer is followed by a PAM sequence at the 3' end of the protospacer. Different Type II systems have differing PAM requirements. For example, the *Streptococcus pyogenes* Type II system uses an "NGG" sequence, where "N" can be any nucleotide. The gRNA may target any nucleic acid sequence such as the genes mentioned above. The CRISPR/Cas9-based system may use gRNA of varying sequences and lengths. The gRNA may comprise a complementary polynucleotide sequence of the target DNA sequence followed by a PAM sequence. The gRNA may comprise a "G" at the 5' end of the complementary polynucleotide sequence. The gRNA may comprise at least a 10 base pair, at least an 11 base pair, at least a 12 base pair, at least a 13 base pair, at least a 14 base pair, at least a 15 base pair, at least a 16 base pair, at least a 17 base pair, at least an 18 base pair, at least a 19 base pair, at least a 20 base pair, at least a 21 base pair, at least a 22 base pair, at least a 23 base pair, at least a 24 base pair, at least a 25 base pair, at least a 30 base pair, or at least a 35 base pair complementary polynucleotide sequence of the target DNA sequence, wherein said target sequence is derived from the coding sequence of a gene selected from the group consisting of itaconyl-CoA transferase, itaconyl-CoA hydratase (citramalyl-CoA hydro-lyase) and/or citramalyl-CoA lyase, followed by a PAM sequence. The PAM sequence may be "NOG", where "N" can be any nucleotide. The gRNA may target at least one of the promoter region, the enhancer region or the transcribed region of the target gene.

Two or more sequences (polynucleotide or amino acid) can be compared by determining their percent identity. The percent identity of two sequences, whether nucleic acid or amino acid sequences, is the number of exact matches between two aligned sequences divided by the length of the shorter sequences and multiplied by 100. An approximate alignment for nucleic acid sequences is provided by the local homology algorithm of Smith and Waterman, Advances in Applied Mathematics 2:482-489 (1981). This algorithm can be applied to amino acid sequences by using the scoring matrix developed by Dayhoff, Atlas of Protein Sequences and Structure, M. O. Dayhoff ed., 5 suppl. 3:353-358, National Biomedical Research Foundation, Washington, D.C., USA, and normalized by Gribskov, Nucl. Acids Res. 14(6):6745-6763 (1986). An exemplary implementation of this algorithm to determine percent identity of a sequence is provided by the Genetics Computer Group (Madison, Wis.) in the "BestFit" utility application. The default parameters for this method are described in the Wisconsin Sequence Analysis Package Program Manual, Version 8 (1995) (available from Genetics Computer Group, Madison, Wis.). A preferred method of establishing percent identity in the context of the present disclosure is to use the MPSRCH package of programs copyrighted by the University of Edinburgh, developed by John F. Collins and Shane S. Sturrok, and distributed by IntelliGenetics, Inc. (Mountain View, Calif.). From this suite of packages the Smith-Waterman algorithm can be employed where default parameters are used for the scoring table (for example, gap open penalty of 12, gap extension penalty of one, and a gap of six). From the data generated the "Match" value reflects sequence identity. Other suitable programs for calculating the percent identity or similarity between sequences are generally known in the art, for example, another alignment program is BLAST, used with default parameters. For example, BLASTN and BLASTP can be used using the following default parameters: genetic code=standard; filter=none; strand=both; cutoff=60; expect=10; Matrix=BLOSUM62; Descriptions=50 sequences; sort by=HIGH SCORE; Databases=non-redundant, GenBank+EMBL+DDBJ+PDB+GenBank CDS translations+Swiss protein+Spupdate+PIR. Details of these programs can be found at the following internet address: www.ncbi.nlm.gov. With respect to sequences described herein, the range of desired degrees of sequence identity is approximately 80% to 100% and any integer value there between. Typically the percent identities between sequences are at least 70-75%, preferably 80-82%, more preferably 85-90%, even more preferably 92%, still more preferably 95%, and most preferably 98% sequence identity.

Alternatively, the degree of sequence similarity between polynucleotides can be determined by hybridization of polynucleotides under conditions that allow formation of stable duplexes between homologous regions, followed by digestion with single-stranded-specific nuclease(s), and size determination of the digested fragments. Two nucleic acid, or two polypeptide sequences are substantially homologous to each other when the sequences exhibit at least about 70%-75%, preferably 80%-82%, more preferably 85%-90%, even more preferably 92%, still more preferably 95%, and most preferably 98% sequence identity over a defined length of the molecules, as determined using the methods above. As used herein, substantially homologous also refers to sequences showing complete identity to a specified DNA or polypeptide sequence. DNA sequences that are substantially homologous can be identified in a Southern hybridization experiment under, for example, stringent conditions, as defined for that particular system. Defining appropriate hybridization conditions is within the skill of the art. See, e.g., Sambrook et al., supra; Nucleic Acid Hybridization: A Practical Approach, editors B. D. Hames and S. J. Higgins, (1985) Oxford; Washington, D.C.; IRL Press).

Selective hybridization of two nucleic acid fragments can be determined as follows. The degree of sequence identity between two nucleic acid molecules affects the efficiency and strength of hybridization events between such molecules. A partially identical nucleic acid sequence will at least partially inhibit the hybridization of a completely identical sequence to a target molecule. Inhibition of hybridization of the completely identical sequence can be assessed using hybridization assays that are well known in the art (e.g., Southern (DNA) blot, Northern (RNA) blot, solution hybridization, or the like, see Sambrook, et al., Molecular Cloning: A Laboratory Manual, Second Edition, (1989) Cold Spring Harbor, N.Y.). Such assays can be conducted using varying degrees of selectivity, for example, using conditions varying from low to high stringency. If conditions of low stringency are employed, the absence of non-specific binding can be assessed using a secondary probe that lacks even a partial degree of sequence identity (for example, a probe having less than about 30% sequence identity with the target molecule), such that, in the absence of non-specific binding events, the secondary probe will not hybridize to the target.

The (recombinant DNA) constructs for use in the methods according to the present invention may be constructed using recombinant DNA technology well known to persons skilled in the art. The recombinant gene constructs may be inserted into vectors, which may be commercially available, suitable for introducing into micro-organisms and suitable for expression of the gene product in the transformed cells.

Selectable markers, which may be included as a part of the introduced recombinant DNA, are used to select transformed or transfected cells (those containing recombinant DNA) over untransformed cells. Examples of suitable markers include genes that provide antibiotic resistance. Cells containing the recombinant DNA are capable of surviving in the presence of antibiotic concentrations that kill untransformed/untransfected cells.

The target organism is a micro-organism which is capable of producing itaconic acid. This property may be endogenous, or it may be introduced into the cell by recombinant genetic technologies. Examples of endogenously itaconic acid producing cells are cells of *Aspergillus terreus*, more particularly *A. terreus* strain TN484-M1 (high yield) and strain CM85J (low yield) (Dwiarti, L. et al., 2002, J. Biosci. Bioeng. 1:29-33), strain NRRL 1960 (Riscaldati, E. et al., 2000, J. Biotechnol. 83(3):219-230; Bonarme, P. et al., 1995, J. Bacteriol. 177(12):3573-3578) and strain L.S.H.T.M. Cat. No. Am. 1 (Calam, C. T. et al., 1939, Thom. J. Biochem. 33:1488-1495) and of *A. itaconicus* (Kinoshita, 1931, Bot. Mag. 45:30), *Ustilago maydis* (WO 2015/140314; Geiser, E. et al., 2016, Microb Biotechnol. (9)1:116-126) and *Aspergillus oryzae* (Jimenez-Quero, A. et al., 2016, J Microbiol Biotechnol., doi: 10.4014/jmb.1603.03073).

Alternatively, a non-natural itaconic acid producing strain can be constructed by introducing the gene for the enzyme cis-aconitic acid decarboxylase derived from any of the above mentioned strains in another micro-organism, preferably *A. niger*. This enzyme converts cis-aconitic acid into itaconic acid. If the host organism lacks sufficient substrate, then it can be contemplated to also introduce the gene(s) coding for the enzyme aconitase and/or the enzyme 2-methylcitrate dehydratase into the same host organism, which enzymes convert the ubiquitous substrate citrate into cis-aconitic acid. The genes coding for the above-mentioned enzymes can be derived from *A. terreus* according to techniques, which are generally known to a person skilled in the art. Also the construction of an expression vector with these genes and the introduction of such a vector into the host organism lies within the skill of the artisans.

In both cases, production of itaconic acid may be further enhanced by the presence of a transporter protein capable of transporting itaconic acid or precursors thereof over the mitochondrial membrane or to export itaconic acid out of the cell. Examples of such transporter proteins and genes are *Aspergillus terreus* ATEG_09970.1 or ATEG_09972.1 as described in WO 2009/110796 and WO 2009/104958.

With respect to *Ustilago maydis* it should be remarked that an alternative itaconic acid biosynthetic pathway was discovered in this micro-organism (see Geiser, E. et al., 2016, Microb Biotechnol. (9)1:116-126). Based on genome mining paralogous genes to this pathway are also present in *A. niger*:

Trans-aconitase decarboxylase An01g02970
Aconitate isomerase An13g01480

However the low level of homology and different genomic organisation of the pathway genes make it unlikely that this pathway is functional in *A. niger*.

Key in the biosynthetic pathway for itaconic acid is the localisation of the various substrates. It is thought that production of itaconic acid mainly occurs in the cytosol. In many biochemical pathways, the end-product is inhibiting its own production to prevent excess end-product in the biological system. Excess end-product will not only lead to loss of energy in an economical sense, it can also give rise to unwanted side effects such as toxicity. As is shown in the experimental part, it has been demonstrated that at the end of the batch culture of itaconic acid the production levels decrease, which is deemed due to degradation or biochemical conversion of itaconic acid. Moreover, in high level itaconic acid producing strains the biomass formation also decreases which is deemed to be due to the toxic effects of itaconic acid and/or one of its metabolites. It is contemplated that by depleting the cell of itaconic acid the formation of new itaconic acid will continue without end-product inhibition, thus giving—in total—an increase yield of itaconic acid. This can be established by additionally providing the culturing organism with transporters that transport the itaconic acid precursors to the cytosol and which transport the itaconic acid outside the cell. Such transporters have been shown and exemplified in WO 2009/104958 and WO 2009/110796. The genes and methods that are claimed herein are incorporated in the present application by reference.

Additionally the present invention enables an alternative approach by providing mutants with reduced itaconic acid sensitivity alleviating unwanted toxic side effects. Next to the effect of a decrease of end-product inhibition, the present invention also prevents toxic effects caused by an accumulation of products that are produced by the enzymes that break down or convert the itaconic acid or its precursoers, the enzymes itaconyl-CoA transferase and/or itaconyl-CoA hydratase (citramalyl-CoA hydro-lyase) and/or citramalyl-CoA lyase. It is believed that the effect of the so-called organic acid toxicity (which then would be caused by the presence of the itaconic acid) is not caused by the itaconic acid itself, but by the CoA-ester generated in the first step of the metabolic pathway departing from the organic acid. Hence, inhibition of the enzymes as indicated will give rise to a higher concentration of itaconate without the toxic effects that are attributed to this higher amount of the organic acid, both inside the cell as well as excreted to the culture medium.

Although the enzymes as they occur in *Aspergillus* have a localization signal which targets the expression of these enzymes to the mitochondrion, inhibition of these genes has been found advantageous even if the itaconic acid is predominantly present in the cytosol. The theory to explain this is that probably there is still a form of active transport between cytosol and mitochondrion and if the itaconic acid is degraded in the mitochondrion and thus depleted, the balance should be restored by transporting itaconic acid to the mitochondrion. Accordingly, the amount of itaconic acid in the cytosol is thereby decreasing.

Degradation of itaconic acid has been shown to occur in the pathogenic bacteria *Yersinia pestis* and *Pseudomonas aeruginosa*. This pathway consists of three steps which degrade itaconic acid in the cellular building block chemicals pyruvate and acetyl-CoA. Itaconic acid is converted to itaconyl-CoA by the action of itaconyl-CoA transferase (ICT). Itaconyl-CoA is subsequently converted to citramalyl-CoA by the action of itaconyl-CoA hydratase (ICH) (citramalyl-CoA hydro-lyase) and citramalyl-CoA is cleaved by citramalyl-CoA lyase (CCL) into pyruvate and acetyl-CoA (FIG. 22) (adapted from Sasikaran et al., 2014, Nat. Chem. Biol. 10:371-377). Accordingly, inhibition of expression of any of these three genes blocks degradation and thereby increases the amount of itaconic acid and diminishes the toxic effects caused by the degradation products of itaconic acid.

As is extensively described herein, inhibition of expression of a gene can be achieved in many different ways. Of course, the inhibition is preferably directed against one or more of these enzymes as they occur in the itaconic acid producing micro-organism.

Micro-organisms used in the invention are preferably micro-organisms that naturally produce itaconic acid. Preferably overexpression of the genes encoding the above described protein(s) and enzyme(s) is accomplished in filamentous fungi, yeasts and/or bacteria, such as, but not limited to *Aspergillus* sp., such as the fungi *A. terreus*, A. itaconicus and *A. niger, Aspergillus nidulans, Aspergillus oryzae* or *Aspergillus fumigatus, Ustilago zeae, Ustilago maydis, Ustilago* sp., *Candida* sp., *Yarrowia lipolytica, Rhodotorula* sp. and *Pseudozyma antarctica*, the bacterium *E. coli* and the yeast *Saccharomyces cerevisiae*. Especially preferred are heterologous citric acid producing organisms in which the substrates are available in the host organism.

It has also been established (see US 2004/0033570) that the so-called D4B segment of *Aspergillus terreus*, which comprises the CAD gene is responsible for the synthesis of lovastatin (see FIG. 2 in US 2004/0033570). Thus, it is submitted that also these micro-organisms which are known to produce lovastatin would be suitable candidates for the production of itaconic acid. Such micro-organisms include *Monascus* spp. (such as *M. ruber, M. purpureus, M. pilosus, M. vitreus* and *M. pubigerus*), *Penicillium* spp. (such as *P. citrinum, P. chrysogenum*), *Hypomyces* spp., *Doratomyces* spp. (such as *D. stemonitis*), *Phoma* spp., *Eupenicillium* spp., *Gymnoascus* spp., *Pichia labacensis, Candida cariosilognicola, Paecilomyces virioti, Scopulariopsis brevicaulis* and *Trichoderma* spp. (such as *T. viride*).

Consequently also the CAD encoding part of the D4B segment and the enzyme with CAD activity for which it codes from these above-mentioned lovastatin producing micro-organisms are deemed to be suitable for use in the present invention. It further is contemplated that a heterologous organism, which in nature does not or hardly produce itaconic acid like *Aspergillus niger* or *Aspergillus oryzae* can be used when providing such an organism with a functional pathway for expression of itaconic acid, by overexpression of the above mentioned genes.

A functional pathway for the expression of itaconic acid can be produced by transforming the organisms with the gene coding for cis-aconitate decarboxylase CAD (EC 4.1.1.6) such as such as the enzyme encoded by the nucleic acid sequence of ATEG_09971.1, this further comprises enzymes with similar activities (see EP07112895). The organism can then be further equipped with genes that influence the transport of the metabolic products, such as di/tricarboxylate transporters, capable of transporting, among others, cis-aconitate, citrate or isocitrate from the mitochondrion to the cytosol, preferably the gene encoded by the nucleic acid sequence of ATEG_09970.1. These subsequent processes will lead to an increase in cis-aconitate in the cytosol, which can be further converted to itaconic acid, using overexpression of the gene encoding the enzyme CAD.

Also optionally such organisms may also comprise an enzyme that is able to transport itaconic acid or itaconate over the cell membrane, such as the enzyme coded by the nucleic acid sequence of ATEG_09972.1.

Even further optimisation of the present invention can be achieved by modulating the activity of the regulator protein that comprises a zinc finger and a fungal specific transcription factor domain as can be found on the gene cluster that also comprises ATEG_09970, wherein this regulator protein is indicated as ATEG_09969.1.

Micro-organisms overexpressing these enzymes, methods to provide such micro-organisms and the sequence information of the genes from the ATEG cluster have been extensively described in the applications WO 2009/014437, WO 2009/104958 and WO 2009/110796, which are hereby incorporated by reference.

The above described processes alone or in combination lead to a subsequent increase of itaconic acid. The combination of improved production and reduction of toxicity leads to an increase in itaconic acid yield by a suitable host. The above described genes are preferably derived from *Aspergillus* sp. like, *Aspergillus terreus, Aspergillus niger, Aspergillus nidulans, Aspergillus oryzae* or *Aspergillus fumigatus*. However, it is also possible to derive the genes from other itaconate producing micro-organisms such as *Ustilago zeae, Ustilago maydis, Ustilago* sp., *Pseudozyma antarctica, Candida* sp., *Yarrowia lipolytica*, and *Rhodotorula* sp.

Recombinant host cells as described above can be obtained using methods known in the art for providing cells with recombinant nucleic acids. These include transformation, transconjugation, transfection or electroporation of a host cell with a suitable plasmid (also referred to as vector) comprising the nucleic acid construct of interest operationally coupled to a promoter sequence to drive expression. Host cells of the invention are preferably transformed with a nucleic acid construct as further defined below and may comprise a single but preferably comprises multiple copies of the nucleic acid construct. The nucleic acid construct may be maintained episomally and thus comprise a sequence for autonomous replication, such as an ARS sequence. Suitable episomal nucleic acid constructs may e.g. be based on the yeast 2μ or pKD1 (Fleer et al., 1991, Biotechnology 9: 968-975) plasmids. Preferably, however, the nucleic acid construct is integrated in one or more copies into the genome of the host cell. Integration into the host cell's genome may occur at random by illegitimate recombination but preferably the nucleic acid construct is integrated into the host cell's genome by homologous recombination as is well known in the art of fungal molecular genetics (see e.g. WO 90/14423, EP-A-0 481 008, EP-A-0 635 574 and U.S. Pat. No. 6,265,186) Most preferably for homologous recombination the ku70Δ/ku80Δ techniques is used as described for instance in WO 02/052026 and Krappmann, 2007, Fungal Biol. Rev. 21:25-29).

Transformation of host cells with the nucleic acid constructs of the invention and additional genetic modification of the fungal host cells of the invention as described above may be carried out by methods well known in the art. Such methods are e.g. known from standard handbooks, such as Sambrook and Russel (2001) "Molecular Cloning: A Laboratory Manual (3rd edition), Cold Spring Harbor Laboratory, Cold Spring Harbor Laboratory Press, or F. Ausubel et al, eds., "Current protocols in molecular biology", Green Publishing and Wiley Interscience, New York (1987). Methods for transformation and genetic modification of fungal host cells are known from e.g. EP-A-0 635 574, WO 98/46772, WO 99/60102 and WO 00/37671.

In a further aspect the invention relates to fermentation processes in which the transformed host cells of the invention are used for the conversion of a substrate into itaconic acid. A preferred fermentation process is an aerobic fermentation process. The fermentation process may either be a submerged or a solid state fermentation process.

In a solid state fermentation process (sometimes referred to as semi-solid state fermentation) the transformed host cells are fermenting on a solid medium that provides anchorage points for the fungus in the absence of any freely flowing substance. The amount of water in the solid medium can be any amount of water. For example, the solid medium could be almost dry, or it could be slushy. A person skilled in the art knows that the terms "solid state fermentation" and "semi-solid state fermentation" are interchangeable. A wide variety of solid state fermentation devices have previously been described (for review see, Larroche et al., "Special Transformation Processes Using Fungal Spores and Immobilized Cells", Adv. Biochem. Eng. Biotech., (1997), Vol 55, pp. 179; Roussos et al., "Zymotis: A large Scale Solid State Fermenter", Applied Biochemistry and Biotechnology, (1993), Vol. 42, pp. 37-52; Smits et al., "Solid-State Fermentation-A Mini Review, 1998), Agro-Food-Industry Hi-Tech, March/April, pp. 29-36). These devices fall within two categories, those categories being static systems and agitated systems. In static systems, the solid media is stationary throughout the fermentation process. Examples of static systems used for solid state fermentation include flasks, petri dishes, trays, fixed bed columns, and ovens. Agitated systems provide a means for mixing the solid media during the fermentation process. One example of an agitated system is a rotating drum (Larroche et al., supra). In a submerged fermentation process on the other hand, the transformed fungal host cells are fermenting while being submerged in a liquid medium, usually in a stirred tank fermenter as are well known in the art, although also other types of fermenters such as e.g. airlift-type fermenters may also be applied (see e.g. U.S. Pat. No. 6,746,862).

Preferred in the invention is a submerged fermentation process, which is performed in a fed-batch or repeated (fed-)batch mode. In a fed-batch fermentation there is a continuous input of feed containing a carbon source and/or other relevant nutrients in order to improve itaconic acid yields. The input of the feed can, for example, be at a constant rate or when the concentration of a specific substrate or fermentation parameter falls below some set point. In a repeated batch fermentation the culture is harvested at regular time-intervals by stopping the fermentation and retrieving the produced product from the medium. Next to refreshing the medium often also part of the microbial culture is discarded, while the rest is used as a new inoculum for a following batch culture.

It is preferred to use a host cell that naturally would contain the enzymes/transporters of the itaconic acid pathway as depicted in FIG. 21, and the enzymes/transporters of the citric acid pathways in the cytosol and mitochondrion. However, if the host would lack one or more of these genes, they can be co-introduced with the above described enzymes and proteins. Such a co-introduction can be performed by placing the nucleotide sequence of such a gene on the same plasmid vector as the above described genes, or on a separate plasmid vector.

Further, since the itaconic acid pathway is located partly in the cytosol and partly in the mitochondrion, it is contemplated that overexpression of the genes/enzymes in either or both of those compartments would be desirable. The person skilled in the art will know how to achieve overexpression in the cytosol or mitochondria by using the appropriate signal sequences.

As is already described above, a further part of the invention is formed by a strain that is 'resistant' to the toxic effects of itaconic acid and/or its metabolites. Such a strain may be obtained through spontaneous mutation and selection of strains growing in the presence of concentrations of itaconic acid that are inhibitory to the non-mutant strains. Among these itaconic acid resistant strains are those strains producing high levels of itaconic acid. In such a way the two strains EE #25 and EE #26 that are deposited under the Budapest Treaty with the Westerdijk Fungal Biodiversity Institute (formerly known as the Centraal Bureau Schimmelcultures (CBS)) in Utrecht (The Netherlands) on 17 Aug. 2017 with accession numbers CBS141661 and CBS141662 have been obtained. It is of course also possible to induce mutations by chemical or radiation treatment and selection for high itaconic acid producing strains.

EXAMPLES

Improved Production of Itaconic Acid by Reducing/Removing Itaconic Acid Degradation and/or Biochemical Conversion Introduction The invention relates to the field of microbial production of itaconic acid in fungi. The invention comprises results showing increased itaconic acid levels by reducing toxicity degradation and/or biochemical conversion of itaconic acid, by
 (1) reducing/removing itaconyl-CoA transferase, itaconyl-CoA hydratase (citramalyl-CoA hydro-lyase) and/or citramalyl-CoA lyase activity from the production host.
 (2) reducing IA sensitivity of the production host by mutant selection.

Besides reducing itaconic acid levels modification in the conversion pathways can also affect the influence of itaconic acid sensitivity of an itaconic acid producing strain, since organic acid toxicity is often not mediated by the organic acid itself but by the CoA-ester generated in the first step of the conversion pathway. Disruption of CoA transferase activity could result in reduced toxicity effects. All strains and transformants used are listed in Table 1.

TABLE 1

Strains and transformants used.

| Strains and transformants | CBS deposit number | Strain description | Reference |
|---|---|---|---|
| *Aspergillus terreus* | | | |
| NRRL 1960 | CBS 116.46 | IA producing *A. terreus* WT strain | — |
| *Aspergillus niger* | | | |
| AB1.13 CAD 10.1 | — | Selected cadA transformant (amdS+) derived from WT strain AB1.13 (pyrG−) | Li et al. BMC Biotechnol. (2012) 12: 57 |

TABLE 1-continued

Strains and transformants used.

| Strains and transformants | CBS deposit number | Strain description | Reference |
|---|---|---|---|
| AB1.13 CAD 4.1 | CBS 141653 | Selected pyrG transformant derived from AB1.13 CAD 10.1 | Li et al. BMC Biotechnol. (2012) 12: 57 |
| AB1.13 CAD MFS 3.9 | CBS 141655 | Selected mfsA transformant (pyrG+) derived from AB1.13 10.1 | Li et al. Appl. Microbiol. Biotechnol. (2013) 97: 3901-11 |
| AB1.13 #49B | CBS 141657 | Selected mttA transformant (hygB+) derived from AB1.13 CAD MFS 3.9 | Hossain et al. Microb. Cell Fact. (2016) 15: 130 |
| CitB #77, #101 | — | Selected citB transformants (phleo+) derived from AB1.13 #49B | Hossain et al. Microb. Cell Fact. (2016) 15: 130 |
| CitB #99 | CBS 141659 | Selected citB transformant (phleo+) derived from AB1.13 #49B | Hossain et al. Microb. Cell Fact. (2016) 15: 130 |
| CitB #113 | CBS 141660 | Selected citB transformant (phleo+) derived from AB1.13 #49B | Hossain et al. Microb. Cell Fact. (2016) 15: 130 |
| EE #3, #7, #9, #10, #13 | — | Laboratory evolved mutants of CitB #99 able to grow at high IA concentrations | Hossain et al. unpublished results |
| EE #25 | CBS 141661 | Laboratory evolved mutant of CitB #99 able to grow at high IA concentrations | Hossain et al. unpublished results |
| EE #26 | CBS 141662 | Laboratory evolved mutant of CitB #99 able to grow at high IA concentrations | Hossain et al. unpublished results |
| CitB #99 pyrE #67 | CBS 143054 | Selected pyrE mutant derived from CitB #99 | Hossain et al. unpublished results |
| CitB #99 ΔICT #RD1 | CBS 143055 | ictA (An07g00760) deletion strain (pyrE+) of CitB #99 pyrE #67 | Hossain et al. unpublished results |
| CitB #99 ΔICH #RB2 | CBS 143056 | ichA (An07g09220) deletion strain (pyrE+) of CitB #99 pyrE #67 | Hossain et al. unpublished results |
| CitB #99 ΔTMT #6 | CBS 143057 | tmtA (An16g06510) deletion strain (pyrE+) of CitB #99 pyrE #67 | Hossain et al. unpublished results |
| AN39 pyrE #4 | CBS 143052 | Selected pyrE mutant derived from industrial citric acid production strain AN39 (WT) (CBS 140903) | unpublished results |
| Aceet #1 | CBS 143053 | Selected cadA and citB transformant (amdS+) derived from AN39 pyrE #4 | unpublished results |
| Q199 | CBS 143051 | Selected mttA and mfsA transformant (pyrE+) derived from Aceet#1 | unpublished results |
| Q199 ΔICT #4 | CBS 143050 | ictA (An07g00760) deletion strain (hygB+) of Q199 | unpublished results |
| CAD MFS #15 | CBS 143047 | Selected cadA and mfsA transformant (amdS+) derived from AN39 pyrE #4 | unpublished results |
| CAD MFS #15 pyrE #8 | CBS 143048 | Selected pyrE mutant (FOA resistant) of CAD MFS #15 | unpublished results |
| CAD MFS #15 MTT CITB CAD MFS ΔICThygB #21 | CBS 143049 | Selected ictA (An07g00760) deletion, cadA, mttA, mfsA, citB transformant (hygB+) derived from CAD MFS #15 pyrE #8 | unpublished results |

Strains CBS 141653, CBS 141655, CBS 141657, CBS 141659, CBS 141660, CBS 141661 and CBS 141662 have been deposited as 'safe deposits' on 21 Jul. 2016 with the Westerdijk Fungal Biodiversity Institute (formerly known as the Centraal Bureau Schimmelcultures (CBS)). On 17 Aug. 2017 these deposits were converted into deposits under the Budapest treaty. Strains with CBS no's 143047 to 143057 were deposited under the Budapest Treaty on 24 Jul. 2017 in the CBS collection of the Westerdijk Fungal Biodiversity Institute (The Netherlands).

Example I

Controlled Fermentation of Itaconic Acid Producing Host Strains Shows Reduced IA Levels at the End of the Fermentation Controlled fermentations were carried out with an itaconic acid producing *Aspergillus terreus* strain and itaconic acid producing *A. niger* transformant strains carrying the *A. terreus* cadA, mttA, and mfsA genes and overexpressing the *A. niger* citB gene. As shown in FIG. 1, FIG. 2 and FIG. 3 significant decrease in the itaconic acid levels was observed after prolonged fermentation suggesting itaconic acid degradation and/or biochemical conversion as a means of this decrease.

Fermentation Conditions of *A. terreus*

The following conditions were used unless stated otherwise:

37° C.

pH start 3.5, set point 2.3

DO set points Day 1: 75%

Day 2, 3, 4: 50%

Subsequent days: 25%

Preculture: 100 ml of the same medium as used in the fermentation medium ($10^7$ spores/10 in 500 ml Erlenmeyer flask with baffles, overnight, 37° C., 150 rpm pH control: 4M KOH (Base), 1.5 M $H_3PO_4$ (Acid)
Antifoam: Struktol (Schill & Seilacher)
Medium Composition:

Per litre demineralised water: 2.36 g of $NH_4SO_4$, 0.11 g of $KH_2PO_4$, 2.08 g of $MgSO_4*7H_2O$, 0.13 g of $CaCl_2*2H_2O$, 0.074 g of NaCl, 0.2 mg of $CuSO_4*5H_2O$, 5.5 mg of $Fe(III)SO_4*7H_2O$, 0.7 mg of $MnCl_2*4H_2O$ and 1.3 mg of $ZnSO_4*7H_2O$ and 100 g of glucose as a carbon source.

Controlled batch-cultivations with *A. niger* strains CitB #77 and #101 were performed on 5 L scale benchtop New Brunswick Scientific fermenters (BioFlo 3000) at 33° C. Starting pH was 3.5 after inoculation and medium was allowed to naturally acidify till pH 2.3 and then kept at pH 2.3 by addition of 4M KOH. Dissolved oxygen (DO) tension was 25% at moment of inoculation and DO dropped till 20% and kept at 20%. The system was calibrated with 100% sterile air as 100% DO and 100% N2 as 0% DO. The fermenter was inoculated by 72 h old 100 mL baffled shakeflask cultures containing $1.0*10^8$ spores. Medium composition for fermentation and pre-culture (M12+Cu) is listed in Table 2.

Controlled batch-cultivation with Q199 (CBS 143051), a transformant derived from an industrial citric acid production strain (CBS 140903), carrying the IA gene cluster (cadA, mttA, and mfsA) and overexpressing citB was performed at 35° C. instead. The fermenter was inoculated with a 72 h old 100 mL non-baffled shakeflask culture containing $1.0*10^6$ spores. Medium composition for fermentation and pre-culture is listed in Table 2 with the following modifications: 160 g/L glucose was used instead of 100 g/L glucose and 1.43 g/L NH4NO3 and 0.00058 g/L FeCl3*6 H2O were used instead of (NH4)2SO4 and FeSO4.

Strain Q199 (CBS 143051) was constructed via co-transformation of strain Aceet #1 (CBS 143053) with separate expression cassettes containing mttA and mfsA and a pyrE selection marker. Strain Aceet #1 (CBS 143053) was constructed via co-transformation of AN39 pyrE #4 (CBS 143052), a pyrE mutant (created by fluoroorotic acid selection) of an industrial citric acid production strain (CBS 140903), with separate expression cassettes containing cadA-amdS and citB. Sequences of expression cassettes and transformations are described in Hossain et al., 2016, Microb. Cell Fact., 15:130.

TABLE 2

Composition of Medium 12 + Cu, which is used as production medium for IA. Adapted from Li et al. 2012, BMC Biotechnol., 12: 57.

| Component | Final concentration (g/l) |
| --- | --- |
| $(NH_4)_2SO_4$ | 2.36 |
| $KH_2PO_4$ | 0.11 |
| $MgSO_4 * 7H_2O$ | 0.5 |
| $CuSO_4 * 5H_2O$ | 0.005 |
| $FeIISO_4 * 7H_2O$ | 0.0006 |
| $ZnSO_4 * 7H_2O$ | 0.0006 |
| NaCl | 0.074 |
| $CaCl_2 * 2H_2O$ | 0.13 |
| Glucose | 100 |

Example 2

Itaconic Acid Toxicity

Shakeflasks (500 mL) were prepared with 100 mL M12+Cu supplemented with the following IA concentrations: 0, 10, 20, 40, 75 g/l and pH was adjusted to 2.3 by addition of $KOH/H_2SO_4$. The flasks were inoculated with 1 mL of overnight grown pre-culture. After 7 days the mycelium was harvested and the biomass was determined by measuring the dry weight. The effect of IA on the growth of *A. niger* was tested using the AB1.13 CAD 4.1 (CBS 141653) strain. As shown in FIG. 4 the growth of *A. niger* is already hampered at concentrations of 10 g/l IA in the extracellular medium. At even higher concentrations (20, 40 and 75 g/l) the detrimental effects of IA on growth become more evident. Based on this result we hypothesize that IA toxicity may indeed limit its production.

Example 3

Increased IA Levels Result in Reduced Biomass Formation During Controlled Fermentation Again *A. niger* controlled batch-cultivations were performed on 5 L scale benchtop New Brunswick Scientific fermenters (BioFlo 3000) at 33° C. Starting pH was 3.5 after inoculation and medium was allowed to naturally acidify till pH 2.3 and then kept at pH 2.3 by addition of 4M KOH. Dissolved oxygen (DO) tension was 25% at moment of inoculation and DO dropped till 20% and kept at 20%. The system was calibrated with 100% sterile air as 100% DO and 100% $N_2$ as 0% DO. The fermenter was inoculated by 72 h old 100 mL baffled shakeflask cultures containing $1.0*10^8$ spores. Medium composition for fermentation and pre-culture are listed in Table 2 above (adapted from Li et al. 2012, BMC Biotechnol., 12:57).

As shown in FIG. 5 in two high IA producing *A. niger* transformants carrying the IA gene cluster (cadA, mttA, and mfsA) and overexpressing the citB gene concomitant to IA production the amount of biomass produced during controlled fermentation is lower than that of a low IA producing strain AB1.13 #49B (CBS 141657) showing the toxic effect of IA on fungal growth under these conditions.

Example 4

Isolation of *A. niger* Mutant Strains with Reduced Growth Inhibition Towards IA In a laboratory evolution experiment performed with CitB #99 (CBS 141659) strain we have identified and isolated mutant strains with increased resistance towards IA. Selection was performed in several round of growth selection on agar plates with 50-100 g/l of IA. From this evolution experiment mutants were characterized on their IA sensitivity, IA consumption and IA productivity. In a shakeflask experiment these strains were evaluated on their ability to grow in production medium with and without IA (40 g/l). The results of this experiment are shown in FIGS. 6 and 7. From FIG. 6 it becomes apparent that all evolution mutants produce approximately the same amount of biomass when grown in medium devoid of IA. In medium that contains 40 g/l IA evolution mutants EE #25 (CBS141661) and EE #26 (CBS141662) consistently show more biomass in the presence of 40 g/l IA when compared to the parental strain CitB #99. FIG. 7 shows the average inhibition of mycelial growth, confirming less growth inhibition of EE #25 and EE #26 compared to the parental strain CitB #99.

Moreover, the ability of EE #25 and EE #26 to degrade IA, i.e. to take up IA from the medium and metabolize, was assessed together with CitB #99 and AB1.13 CAD 4.1 (CBS 141653), a strain carrying only the heterologous cadA gene. Shakeflasks containing production medium were supplemented with IA (20 g/l) and glucose (1 g/l and 5 g/l). The supplementation with glucose was necessary for conidial germination. Shakeflasks containing production media and supplemented with 1 g/l glucose was used as positive control. All four strains used in this experiment showed consumption of IA (FIG. 8). In medium supplemented with 20 g/l IA and 1 g/l glucose evolution mutant strains EE #25 and EE #26 consumed less IA from the medium compared to CitB #99 and AB1.13 CAD 4.1 (CBS 141653). The same effect can be seen in production medium (Table 2) supplemented with IA and 0.5% glucose (FIG. 8). Together IA evolution mutants EE #25 and EE #26 show decreased sensitivity towards IA and decreased consumption, making them appropriate strains for improved IA production.

The two evolution mutants EE #25 and EE #26 were also compared to their parental strain CitB #99 for IA and CA production. Shakeflasks (125 mL) were filled with 25 mL working volume of IA production medium and inoculated with $1.0 \times 10^6$ spores per ml and incubated at 33° C. for 5 days. After incubation supernatant was filtered through 0.22 µM filter and analyzed on HPLC. Biomass was determined by filtering on Whatmann filters and drying at 105° C. for dry biomass. The two mutant under these conditions produced more IA while CA levels were lower in different cultivation media. In the M12+Cu reference medium 4-fold more IA and 2-fold less CA was produced (FIG. 9), corresponding with a 4-5 fold increase specific productivity (FIG. 10).

Example 5

Genome Mining for Itaconic Acid Catabolism

In filamentous fungi the catabolic pathway for itaconic acid has recently been described based on homology searches using proteins encoded by itaconic acid catabolic pathway genes from bacteria such as *Pseudomonas/Yersinia*, in which the degradation pathway has been described (Chen, M. et al., 2016, Appl. Microbiol. Biotechnol. DOI 10.1007/s00253-016-7554-0).

For both itaconyl-CoA transferase and itaconyl-CoA hydratase at least two possible orthologous genes were identified in *Aspergillus niger* and *A. terreus*. Based on the results published by Chen et al. for *A. terreus* functional homologues for the pathway were identified by expression in *E. coli*.

For *A. niger* the orthologous genes (75-85% identity) were identified (see Table 3). Protein analysis of all three pathway genes indicate mitochondrial localization of the degradation pathway.

TABLE 3

Itaconic acid catabolic pathway protein sequences.
In bold are those protein sequences described in Chen et al., 2016 for A.
terreus (ATEG_XXXXX) and their closest homologues in A. niger
(AnXXgXXXXX). The other sequences represent genes encoding paralogous
proteins of the same gene family.

```
Itaconyl-CoA transferase
An07g00760, ATEG_06299
An18g05120, ATEG_02992, ATEG_03794, ATEG_09143
An11g10300, ATEG_01554

>gi|145237042|ref|XP_001391168.1| CAIB/BAIF family enzyme [Aspergillus
niger CBS 513.88] (An07g00760; Iot) mito: 22, cyto: 3
MPNTRPLVRAACHNLSGMRHASTSATKKAGPLAGITVVSLEQAIAAPFCTRQLADLGARVIKVERPGVGD
FARNYDTRVNGLASHFVWTNRSKESLALDLKKPSDHSVLMRLLGRADVLVQNLAPGASARLGLSYDDLKA
AHPSLIVCNISGYGPDGPYRDKKAYDLLIQSEAGMLSVTGTGKEPAKVGISIADISAGSYAYSNILAALY
QRERDPSKRGCNIDISMLESMVEWMGFPMYYTYENAPGPTPAGASHAAIYPYGPFETGDGTVMLGIQNER
EWAKFCDIVLGQPSLATNERFVNNSLRSQNRDELKKIICDVFSSLSAEQVIARLDAAAIANASVNDMQGV
WNHPQLKARQRWTDVKTPAGSVPALLPPGMTMGDEDTYGARMDAVPDVGEHNKAILAELGLDEGTEK
(SEQ ID NO: 2).

>gi|350635343|gb|EHA23704.1| hypothetical protein ASPNIDRAFT_40237
[Aspergillus niger ATCC 1015] (An07g00760; Ict) mito: 12, cyto: 6,
extr: 6, pero: 2
MRHASTSATKKAGPLAGITVVSLEQAIAAPFCTRQLADLGARVIKVERPGVGDFARNYDTRVNGLASHFV
WTNRSKESLALDLKKPSDHSVLMRLLGRADVLVQNLAPGASARLGLSYDDLKAAHPSLIVCNISGYGPDG
PYRDKKAYDLLIQSEAGMLSVTGTGKEPAKVGISIADISAGSYAYSNILAALYQRERDPSKRGCNIDISM
LESMVEWMGFPMYYTYENAPGPTPAGASHAAIYPYGPFETGDGTVMLGIQNEREWAKFCDIVLGQPSLAT
NERFVNNSLRSQNRDELKKIICDVFSSLSAEQVIARLDAAAIANASVNDMQGVWNHPQLKARQRWTDVKT
PAGSVPALLPPGMTMGDEDTYGARMDAVPDVGEHNKAILAELGLDEGTEK (SEQ ID NO: 3).

>gi|114191143|gb|EAU32843.1| hypothetical protein ATEG_06299
[Aspergillus terreus NIH2624] (ATEG_06299: Ict) mito: 25
MSLSRPLARAWAQTLAPSTRRHTSTQAGKTGPLTGITVVSLEQATAAPFCTRQLADLGARVIKVERPGVG
DFARNYDTRVNGLASHFVWTNRSKESLALDVKKPRDHQVLMRLLSKADVLVQNLAPGASARLGLSHEDLK
ATNPSLIVCNISGYGPDGPYRDKKAYDLLIQSEAGMLSVTGTGKEPAKVGISIADISAGCYAYSNILAAL
IQRDKDPKRRGCNIDISMLESMVEWMGFPMYYTYANAPGPTPTGASHAATYPYGPFETGDGSVMLGIQNE
REWTNFCDKVLGKPELATDSRFANNSLRSQNREELKIIICEVFSSLTADQVIARLDGASIANASVNDMQG
VWKHPQLKARGRWTEIETPAGTVPALFPPGMDASANFAARMDAVPAVGEHNESILAELGMKESK
(SEQ ID NO: 4).
```

Blast alignments for these genes are provided in FIG. 11.

TABLE 3-continued

Itaconic acid catabolic pathway protein sequences.
In bold are those protein sequences described in Chen et al., 2016 for A. terreus (ATEG_XXXXX) and their closest homologues in A. niger (AnXXgXXXXX). The other sequences represent genes encoding paralogous proteins of the same gene family.

Itaconyl-CoA hydratase
An07g09220, ATEG_03709
An17g02190, ATEG_09462

\>gi|45238698|ref|XP_001391996.1| hypothetical protein ANI_1_2118064 [Aspergillus niger CBS 513.88] (An07g09220: Ich) mito: 21, cyto: 3, nucl: 2
MSLPSITRCSTRHLLRPQSLTPQLTRTFSIRPALRTDTSASTIATSFLTRFQSLGPQTRSQTLDANQLQL
LSLTLNRPSLFPNSPSLSNTPTSLPTGTPLPAGYHLVYFTPAFLENELGADGTDTSYNPASPFTRRMWAG
GEVHWPRGKDGKPNCLRVGQEVQETTRVLSAEPKVVRKTGEEMIVVGVEKEFRNENGVAVLDRRNWVERK
ALTSPSPTSSSTPPATKAFNGPASSSTETSENVHTRTLRQTAVTLFRFSALTFNPHKIHYSTPWARDVEG
HKDIVVHGPLNLISILDLWRDTRKNGSGEEVVLPEKISYRATSPLYAEEEYRIVLEDGEDGIGRVQIIAP
GEVVAMKAEIQ (SEQ ID NO: 5).

\>gi|350635935|gb|EHA24296.1| hypothetical protein ASPNIDRAFT_180396 [Aspergillus niger ATCC 1015] (An07g09220: Ich) mito: 23, cyto: 3
MSLPSITRSSTRTLLRPQTVTPQLTRAFSIRPALRTDTSASTIATSFLTRFQSLGPQTRSQILDANQLRL
LSLTLNRPSLFPNSPSLSNTPTSLPTGTPLPAGYHLVYFTPAFLENELGADGTDTSYNPASPFTRRMWAG
GEVHWPRGKDGKPNYLRVGQEVQETTRVLSAEPKVVRKTGEEMIVVGVEKEFRNEDGVAVLDRRNWVERK
ALTSPSPTSSSTPPATKAFNGPASSSTETSENVHTRTLRQTAVTLFRFSALTFNPHKIHYSTPWARDVEG
HKDIVVHGPLNLISILHLWRDTRKNGSGEEVVLPEKISYRATSPLYAEEEYRIVLEDGEDGIGRVQIVAP
GEVVAMKAEIQ (SEQ ID NO: 6).

\>gi|114193811|gb|EAU35511.1| conserved hypothetical protein [Aspergillus terreus NIH2624] (ATEG_03709: Ich) mito: 23.5, cyto mito: 13.5
MSIHTSARWAMRSVPPLTQGCAALRRFSVQHSCRSAPEATAPSVAASFLSRFQSMGPQTRSQVLDANQLQ
LLSLTLNRPSLYPNSPSLSNASGVVPTGTPLPPAYHLVYFTPAFLEGELGADGTDVSYNPEPPFTRRMWA
GGEVQWPRGADGKPNPLRVGQEVQETTRVLSAEPKIIRKTGDEMIVVSVEKEFRNEHGVAVIDRRNWVER
KALALASSPVSASPISVHLPALPASCSTSTVGKTHTRTLRQTAVTLFRFSALTENPHKIHYSTPWARDVE
GHKDIVVHGPLNLISILDLWRDTRADSATDSSLLLPESISYRATSPLYAEETYRIVLDEEQGDGVSRVQI
FTPDEKVAMKAEIR (SEQ ID NO: 7).

Blast alignments for these genes are provided in FIG. 12.

Citramalyl-CoA lyase
An01g08610, ATEG_03186

\>gi|145229949|ref|XP_001389283.1| citrate lyase beta subunit [Aspergillus niger CBS 513.88] (An01g08610: Ccl) mito: 26
MAARNTLRRALLYIPGSSQRFIDKSRTLTADCVAYDLEDSVTPHKKAEARSLVRRALDEPAPQGIRERAV
RINSVDSGLALGDLTEVLKSPNLTTIVIPKVNTPSDLTFVNDVITHTLSQQQQQDPSTPRPPISLLALVE
SAKSLTNLTQICASTPLLQGLIFAAEDFALDLSITRTPSLTEFLFARSMIATAARAANLPSTIDLVCTAY
KSTKGDGSPPAVLEEECRDGRRLGENGKQCIHPSQVETAQAIFGPDPEEVKWAVRVCVADEKAARAGRGA
WTLDGKMIDVPVAEKARAVVRKAEACGFDVGKLREEWGHQEPE (SEQ ID NO: 8).

\>gi|350638357|gb|EHA26713.1| citrate lyase [Aspergillus niger ATCC 1015] (An01g08610: Ccl) mito: 26
MAARNTLRRALLYIPGSSQRFIDKSRTLTADCVAYDLEDSVTPHKKAEARSLVRRALDEPAPQGIRERAV
RINSVDSGLALGDLTEVLKSPNLTTIVIPKVNTPSDLTFVNDVITHTLSQQQQQDPSTPRPPISLLALVES
AKSLTNLTQICASTPLLQGLIFAAEDFALDLSITRTPSLTEFLFARSMIATAARAANLPSTIDLVCTAYK
STKGDGSPPAVLEEECRDGRRLGFNGKQCIHPSQVETAQAIFGPDPEEVKWAVRVCVADEKAARAGRGAW
TLDGKMIDVPVAEKARAVVRKAEACGFDVGKLREEWGHQEPE (SEQ ID NO: 9).

\>gi|114194760|gb|EAU36460.1| conserved hypothetical protein [Aspergillus terreus NIH2624] (ATEG_03186: Ccl) mito: 25, cyto: 1.5
MASRNTLRRALLYIPGSSQRFIDKSRTLTADCVAYDLEDSVTPHKKAEARSLVRRALDQPAPTGILERAV
RINSVDSGLALADLTEVLQSPNLSTIVIPKVNSASDLFVTDVITHTLSQLPPSQTTSRPPISLLALVES
AKSLTNLSQICAASPLLQGLIFAAEDFALDLSLTRTPALTEFLFARSAIATAARAANLPSTIDLVCTTYK
SDKADGSPPAVLQQECRDGKNLGFNGKQCIHPSQVSTVQQIFGPELEEVQWAVRVTIADDKAAKAGRGAW
TLDGKMIDIPVAEKARAIVKKADACGFNVQELREKWQHQEPE (SEQ ID NO: 10).

Blast alignments for these genes are provided in FIG. 13.

Example 6

Genome Mining for Itaconic Acid Esterification

In relation to conversion of itaconic acid towards related methyl-itaconic esters recent publications (Zhao et al., 2015, WO2015181310/WO2015181312) showed the role of trans-aconitate methyltransferases (tmt-1) in the production of mono- and di-esters. Genome mining in *A. terreus* revealed the presence of a tmt-1 like methyl-transferase homologue (30% identity to *S. cerevisiae* tmt-1), with no mitochondrial targeting sequence prediction. In *A. niger* no close homologue to this protein was discovered. Many weak methyl-transferase homologues are observed. Some of these genes are part of gene clusters. In *A. niger* ATCC 1015 additional/different homologues are present than in *A. niger* CBS 513.88. In both *A. terreus* and *A. niger* also a cis-aconitate 2-methyltransferase homologue is present, predicted to be mitochondrially localized (Table 4).

TABLE 4

Itaconic acid methyltransferase pathway.

| |
|---|
| Trans-aconitate 3-methyltransferase (tmt-1) ATEG_06208 |
| Trans-aconitate 2-methyltransferase (tmt-2) ATEG_04223, An16g06510 |

>gi|317036255|ref|XP_001397953.2| trans-aconitate 2-methyltransferase
[*Aspergillus niger* CBS 513.88] An16g06510 mito: 21, nucl: 5
MFRPRLPLSPHRFSHLRSHPAKTSDWSATQYLKFADERAIPTQDLLSHIPLQSPSHIVDLGCGPGNSTAM
LSARYPSCPSISGIDSSPNMIARAKESSNNNTTFAVADVETYSPPPNQPVDLFFSNAVLHWLPRSTRLPT
IRRLLLALPPGGVFAFQVPDTLNEPSHTSMREVARTGPWAEHLRGTLVERDELDSPGEIYDALVDCCESL
RIWESVYYHSLGSWGEIVEWVKGTGLRPYLDGLRGEEERGEFLKVYEEKLREKYEKRADGRVLLRYPRLF
AVAVRK (SEQ ID NO: 11).

>gi|350633811|gb|EHA22176.1| hypothetical protein ASPNIDRAFT_40903
[*Aspergillus niger* ATCC 1015] An16g06510: trans-aconitate 2-
methyltransferase) cyto: 13, cyto nucl: 12.333, cyto mito: 9.999, nucl:
8.5, mito: 5.5
MSDWSATQYLKFADERAIPTQDLLAHIPLQSPSHIVDLGCGPGNSTAMLSARYPSCPSISGIDSSPNMIA
RAKESSNNNTTFAVADVETYSPPTNHPVDLFFSNAVLHWLPRSTRLPTIRRLLLTLPPGGVFAFQVPDTL
NEPSHTSMREVARTGPWAEHLRSTLVERDELESPGEIYDALVDCCESLRIWESVYYHSLGSWGEIVEWVK
GTGLRPYLDGLRGEEERGEFLKVYEEKLREKYEKRADGRVLLRYPRLFAVAVRK (SEQ ID NO: 12).

>gi|115391793|ref|XP_001213401.1| trans-aconitate 2-methyltransferase
[*Aspergillus terreus* NIH2624] (ATEG_04223: trans-aconitate 2-
methyltransferase) mito: 13.5, cyto mito: 10.833, cyto: 7, pero: 5,
cyto nucl: 4.833
MSTAKPTTTKDWSASQYLKFADERTLPARELLARVPLEAPKTIVDLGCGPGNSTAVLAARYPGAHIVGLD
SSPDMIQKAKSTLPEIDFRVADLRSYTPSSPTDLFFSNAVLQWLRRDERIEVVKRLLRTQSPGGVFAFQV
PDNLMEPSHVLMRDVAARGPWAETLTHVHRDGIQSPQEIYDELIPLCATVSIFHTHYYHSLENHEAIVEW
LKGTGLRPYVDPLGPAEKKAFIAEYLKRLEGAYPRSVDGRVLLRFPRLFVVAVRK
(SEQ ID NO: 13).

Blast alignments for these genes are provided in FIG. 14.

Example 7

Genome Mining for Alternative IA Biosynthetic Pathway

Based on data by Geiser et al. (Microb Biotechnol. 2016 January; 9(1): 116-126.) in the filamentous fungus *Ustilago maydis* an alternative IA biosynthetic pathway was discovered. Based on genome mining paralogous genes to this pathway are also present in *A. niger* (see Table 5).

TABLE 5

Alternative itaconic acid pathway.

Trans-aconitate decarboxylase UMAG_05076 homologues of *A. niger*.

UMAG_05076
>gi|961452800|gb|ALS30796.1| trans-aconitate decarboxylase 1 [*Ustilago maydis*]
MAPALNANPTTKRDELSAPSASHKLGMSSMASRAAGGGLKLTGLPDLSDSAGTLSDIFGTPQMREIWSDQ
NRVACYLEIEAALAIVQADLGIIPKNAAHEIVEHCRVQEIDWALYKQKTELIGYPVLGIVQQLVANCKDG
LGEYCHWGATTQDITDTATVMQIRQSLTLVKQRLDSIVSSLEHLAEQHRNVPMAARSNLKQAVPITFGFK
MARFLATFRRHQQRLVELEKRVYTLEFGGAAGNLSSLGDQGIATHDALAKMLDLAPAEIAWHTEHDRFAE
VGTFLGLLTGTLAKLATDIKLMSQTEVGEVGEPFISNRGSSSTMPQKNNPISCVYIHACAANVRQGAAAL
LDAMQSDHERGTGPWEIIWVQLPLMMNWTSAALNNADFVLRGLQVFPDAMQHNLDLSKGLIVSEAVMMGL
GNTLGRQYAHDAVYECCRTAFVQDRPLLDVLLENHEIASKLDRTELEKLCDPANYLGQCSQWIDRVLSRP
SSA (SEQ ID NO: 14).

An14g01340
>gi|317034933|ref|XP_001400761.2| argininosuccinate lyase [*Aspergillus niger* CBS 513.88]
MLNSAVDSRIFRNLFGTEEIRDIFSDEAYIKCLIEVEIALARAEATFNVIPQESADVIAEKAKYENLNLS
RMAADTENVGYPVLPLVWQLAEMVPQEHAKYIHWGATTQDIMDCASMVQIRRGLVVVRRNLHELDTALRA
LSEKYADTPMAGRTHLQHALPITFGYKCAVYLSGIQRHIQRLAEIELRCLLVQFGGAAGTLASLGSDNTG
LQVRKQLARELGLHDPSITWHVARDHVAEVVNFLALVGGSLGKIALDIIIMSSNEVAEVAEPFVPFRGAS
STMPQKRNPISSEVILASSKLLRSNASLALDAMVSDFERASGPWHLEWSCIPDSFVLCCGALHQANFIMR
GLLVNTDVMSSNLNMTKGLIVAEAVMMGTAPKIGRQRAHDVVYEACTKAIEGNLPLIDILRQDESLVAQV
GEEKLRSLCDPCQYLGCCRQMIENVIQYE (SEQ ID NO: 15).

An01g02970
>gi|145228845|ref|XP_001388731.1| argininosuccinate lyase [*Aspergillus niger* CBS 513.88]
MSASSFAQLCRITRPRISISPIVSRRYIGSVSAIDSGIFRTLFGTEEIRKVFDDEAYIKRCMDAEAALAR
AQSRCDVIPSQIGEMVTRKLRESKLDMERLRYETEIVGYPILPLVRQLSAICGDEAGKYVHWGATTQDIM
DLASVLQMKEGLDIVEHHLKKVISTLRGLSVKYKDTPMAGRTHLQHALPVTFGYKCAVWLSGFQRHLERL
EQLKDRCLLVQFGGAAGSMASLGTGDDGLRVRKALAEELGLTDPPITWHVARDGIAEITNFLALMGGSMG
KLALDIIIMSSNELGEVSEPFVPHRGASSTMPQKRNPISSEVILAASKILRSNAGLVLDGMVADFERASG
PWHLEWVAIPESFVIAVGALSQTQFALSGLCVHSQKMLENLHSTKGLIVAEAVMMGLAPHVGRQQAHDTV
YEACRESIEANQSLLECLMKKTEVTSKMSEERLSQLYDPVNYLGASTRMVEDVLAVD
(SEQ ID NO: 16).

Aconitate isomerase UMAG_11778 homologues of *A. niger*.

UMAG_11778
>gi|961452802|gb|ALS30798.1| aconitate-delta-isomerase 1 [*Ustilago maydis*]
MLHPIDTTIYRAGTSRGLYFLASDLPAEPSERDAALISIMGSGHPLQIDGMGGGNSLTSKVAIVSASTQR
SEFDVDYLFCQVGITERFVDTAPNCGNLMSGVAAFAIERGLVQPHPSDTTCLVRIFNLNSRQASELVIPV
YNGRVHYDDIDDMHMQRPSARVGLRFLDTVGSCTGKLLPTGNASDWIDGLKVSIIDSAVPVVFIRQHDVG
ITGSEAPATLNANTALLDRLERVRLEAGRRMGLGDVSGSVVPKLSLIGPGTETTTFTARYFTPKACHNAH
AVTGAICTAGAAYIDGSVVCEILSSRASACSASQRRISIEHPSGVLEVGLVPPENAAQSLVDVAVVERSV
ALIAHARVYYTTPDRRRSYDSPLTSPSTPADTHNLFDAAYRPVIQPSDTDVEAPHMLALENKEQCVSRCD
TALHHIVASYGASDAHASDRSLS (SEQ ID NO: 17).

An13g01480
>gi|317034401|ref|XP_001396287.2| hypothetical protein ANI_1_618114 [*Aspergillus niger* CBS 513.88]
MPIQRIMLRQLRHTLPSGSRSLSTKKQHHLPAAYYRGGTSRAIFFKQDDLPADKAKWDPIFRGVLGSPDP
YGRQLDGLGGGISSLSKICVVGKPTHPSADIDYTFVSLGVKTPDVDYSSNCGNMISAVGPFAVDSGLVVP
GLTSASVRIHNTNTGKIVHSSFPVVDGEAAASGEFAIDGVSGTAAPVQLDFVDPAGSRTGKLLPTGQVRD
VFDGVEATCIDVANPCVFVRAEDLEVEGNLTPEEITAHPGLLDRLDSIRRQAGVKMGLADTREAVPGSVP
KICLVSQPGTDTRAVEQKQTKEKVDLLVRALSVGQPHKAVPITVALAVASAARMSGSTVSQVVGEKRVDE
AGITLGHASGNLLVGATFDEEGILRFATVFRTARRLFEGRIFWKG (SEQ ID NO: 18).

An02g11060
>gi|145233725|ref|XP_001400235.1| hypothetical protein ANI_1_3022024 [*Aspergillus niger* CBS 513.88]
MFKYTYRNRVASSARRYLSKQHSIPAAYYRGGTSRAVMFNQAHLPPRSEWDAIFRSVIGSPDPYGRQLDG
LGGGISSLSKVCVVGKSTHPDADVDYTFVSLGVKNSDVDYSSNCGNMISAIGPFALDQKLVSSQTPESAT
VRIHNTNTGKIITASFPVVDGEAASSGNFAIDGVAGTAARIQLDFVNPAGSVTGKMLPTGQTRDEFDGVP TABLE 5-continued Alternative itaconic acid pathway.

```
ATCIDVANPCVFVPASSLGVRGDLTPDDIAAHPDLLQRLDSIRRQAGVKMGIASTTGAVPGSIPKVCMVS
PPQPSKGKDPVDLLVRAISVGQPHKAVPITVALAVSAAARVTGSTVEDATNQDRVSDAGLTIGHASGNLL
VGAQFENDQLTAATVFRTARRLFEGQIYWKS (SEQ ID NO: 19).

An12g05470
>gi|317033882|ref|XP_001395615.2| hypothetical protein ANI_1_1868104
[Aspergillus niger CBS 513.88]
MPKSSQYSLPATYYRGGTSKALFFREDVLPDPGPQRDRLLKRAMGSPEPLQLDGMGGSKAVTSKIAIVRP
STRSDADIDFTFAQVGVARDFIHYGANCGNISAAVGPFAIEEGLVQFRPGRSVDTTVKTQEVRIYNTGTG
KLLSAHFPVSGSGAFEPEGTHEIAGDPGKGSPVLLDYRFTIGAELSRGLLPTGNASDMITVAGKEFEITI
CDIANLCVFANARDFNITGHETAADLTANLDWLAKTQELLGKAAVLAGMSENWKA
(SEQ ID NO: 20).

An18g00050
>gi|317037430|ref|XP_001398476.2| hypothetical protein ANI_1_924164
[Aspergillus niger CBS 513.88]
MTQTYSVTRAEPFTVLPITTKYRSNESVRKSLPAVWMRAGTSKGLFLHRRHLPASKTLWEPILLSAMGSS
KGSSRQIDGVGGASSTTSKVAIVERSNRPGVDVEYTFVQVAPDQPRIDVTGNCGNIASGVGPFALDEGLV
NIPEGEKEVNIKILNTNTGQHIFETVQVATDGSFREDGDYAIPGVEGTASPIRVAFLKPCGSMTGQMFPS
GMHQEMLTVQSRGFGTLAVRVSLVDAANPFVFVDAASLPVEASSSIADAADPVFLGLIEDIRRHGAVRFG
LAENVQAAGQVRGTPKIAILSPATGDVDGVDIEVKAFSMGKPHASLQLTGAVCLGAATIIHGTIAWDLAH
AKEGKEMPKHGMSLGDHQIAGAVPVGIRHPAGVIHTETVLGMDRHGAIDVDRVAVYRTARRLFEGRVFYR
P (SEQ ID NO: 21).
```

The low level of homology and different genomic organization of these pathway genes make it somewhat unlikely that this pathway is functional in *A. niger*.

Blast alignments for these genes are provided in FIGS. 15A and 15B.

Example 8

Gene Expression Analysis

Based on transcriptome analysis in *A. terreus* (see accession GSE73033; Chen, M. et al., 2016, Appl. Microbiol. Biotechnol. DOI 10.1007/s00253-016-7554-0) expression of the three catabolic pathway genes was induced under conditions of IA degradation (40 g/l IA addition to culture medium) causing high itaconic acid levels, whereas the methyltransferase pathway genes were not induced (see Table 6).

TABLE 6

Gene expression analysis in *A. terreus*.

| Protein<br>*A. terreus* | Gene Code | Induced | x-fold (RKPM) |
| --- | --- | --- | --- |
| Itaconyl CoA transferase | ATEG_06299 | induced | 8.2 (130) |
| Itaconyl CoA hydratase | ATEG_03709 | induced | 2.3 (320) |
| Citramalyl-CoA lyase | ATEG_03186 | induced | 5.4 (150) |
| Trans-aconitate 3-methyltransferase (tmt-1) | ATEG_06208 | not induced | <(4) |
| Trans-aconitate 2-methyltransferase | ATEG_04223 | not induced | <(25) |

RKPM values provided between brackets represent induced expression level

Similarly, genome wide gene expression analysis of *Aspergillus niger* strains expressing a functional itaconic acid pathway grown in fermenters was carried out to identify genes co-regulated by the expression of the itaconic acid gene cluster. The following strains were investigated: AB1.13 WT, AB1.13 CAD 4.1 (CBS141653), AB1.13 #49B (CBS141657), CitB #99 (CBS141659), and CitB #113.

Controlled batch-cultivations were performed on 5 L scale benchtop New Brunswick Scientific fermenters (BioFlo 3000) at 33° C. Starting pH was 3.5 after inoculation and medium was allowed to naturally acidify till pH 2.3 and then kept at pH 2.3 by addition of 4M KOH. Dissolved oxygen (DO) tension was 25% at moment of inoculation and DO dropped till 20% and kept at 20%. The system was calibrated with 100% sterile air as 100% DO and 100% N2 as 0% DO. The fermenter was inoculated by 72 h old 100 mL baffled shakeflask cultures containing 1.0*10^8 spores. Medium composition for fermentation and pre-culture (M12+Cu) are listed in Table 2. Biomass samples for RNA isolation were taken at several time points during fermentation and washed with distilled water and frozen in liquid N2. The mycelium was disrupted by bead-beating with 0.1 mm acid-washed Zirconium-Silica beads and RNA extraction proceeded using the ChargeSwitch RNA extraction protocol from Invitrogen (Carlsbad, Calif., USA). Quality control was checked on 1×MOPS/6% Formaldehyde agarose gels and stained with ethidium bromide.

BaseClear in Leiden, NL performed digital gene expression profiling experiments based on RNA-Seq with an Illumina HiSeq 2000 System. Approximately 8-32 M unfiltered paired-end (PE) reads (99 bp/read on ~320 bp cDNA inserts) were obtained. Reads were trimmed of the first 2 bases of the 5' end because these bases showed an aberrantly low GC content. The reads were then further filtered, such that all quality phred scores after filtering are at least 22, with a read-length of at least 40 bases. Around 70-80% of the bases passed these criteria (including a 2% loss because of clipping). After filtering the #PE-reads/samples were between 7.6M and 19.8M for all the samples respectively.

Reads were aligned to the 20 contigs in a FastA file of the *Aspergillus niger* reference genome (from www.ebi.ac.uk). Source EMBL annotations were converted to GFF format. The EMBL data appeared to be derived from multiple sources with different feature tags. These were converted to one uniform GFF format that could be accepted by our third-party software (consistent gene_ids across all contigs). Missing gene definitions (e.g. for CAD) were inserted. The reads were aligned to the reference genome using software based on a Burrows-Wheeler Transform (BWT) algorithm. A mismatch rate of 4% was allowed for the alignment. The maximum insertion length was 3. The maximum deletion length was 3. All samples had more than 85% of the reads aligned, resulting in SAM alignment files. Gene expression was measured as the number of aligned reads to reference genes and was normalized to RPKM values (Reads Per Kb per Million reads; Mortazavi et al., 2008, Nature Methods, 5:621-628).

Several genes possibly related to itaconic acid breakdown were identified (Table 7). In addition, the gene encoding the trans-aconitate 2-methyltransferase (An16g06510) appeared to be induced by itaconic acid. It was also noted that in *A. niger* for all genes the induction levels were different for strains overexpressing different parts of the IA biosynthetic pathway and/or citB overexpression, indicating a role for organic acid transport and localization of product intermediates.

TABLE 7

Gene expression analysis in *A. niger* IA producing strains.

| Protein A. niger | Gene Code | Induced | x-fold (RKPM) |
|---|---|---|---|
| Itaconyl CoA transferase | An07g00760, | induced | 5-70 (750) |
|  | An18g05120, | not induced | <(10) |
|  | An11g10300 | not induced | <(20-30) |
| Itaconyl CoA hydratase | An07g09220 | induced | 4-100 (850) |
|  | An17g02190 | not induced | <(20-30) |
| Citramalyl-CoA lyase | An01g08610 | not induced | <(10-20) |
| Trans-aconitase 3-methyltransferase (tmt-1) | An06g02170 | repressed | 0.2 |
| Trans-aconitate 2-methyltransferase | An16g06510 | induced | 3-30 (750) |
| Trans-aconitase decarboxylase | An01g02970 | not induced | <(10-30) |
|  | An14g01340 | not induced | <(1-3) |
| Aconitate isomerase | An13g01480 | not induced | <(10-30) |
|  | An02g11060, | not induced | <(2-4) |
|  | An12g05470 | not available |  |
|  | An18g00050 | variable | 4-6 (70) |

RKPM values provided between brackets represent induced expression level

As indicated in Table 7 two genes of the proposed IA degradation pathway and the gene encoding a step in the itaconic acid methyltransferase pathway were clearly induced in IA producing *A. niger* transformant strains indicating a role of both pathways in the degradation and/or biochemical conversion of IA during controlled fermentation.

Example 9

Host Strain Modification

Based on the results described in Tables 6 and 7 three genes were identified to be targeted for gene disruption, since their observed overexpression could lead to reduction of the level of itaconic acid produced, namely itaconyl-CoA transferase (An07g00760) and itaconyl-CoA hydratase (An07g09220) and citramalyl-CoA lyase (An01g08610).

Targeted gene disruption of single genes in the catabolic pathway is deemed to result in accumulation of pathway intermediates (in particular CoA esters) which could lead to increased toxicity, therefore also combined disruption mutations are contemplated.

Based on the annotated gene sequences four so-called splitmarker gene disruption cassettes were developed for these 3 genes (see FIG. 16) according to the method described in Arentshorst et al., 2015, Genetic Transformation Systems in Fungi, Vol 1, Fungal Biology, DOI 10.1007/978-3-319-10142-2_25.

Transformations were done in two strains. CitB #99 pyrE #67 (CBS 143054) (selected pyrE mutant of high itaconic acid producing lab-strain CitB #99 (CBS 141659)) was co-transformed with pyrE splitmarkers to create ictA (An07g00760) deletion strain CitB #99 ΔICT #RD1 (CBS 143055), ichA (An07g09220) deletion strain CitB #99 ΔICH #RB2 (CBS 143056), and tmtA (An16g06510) deletion strain CitB #99 ΔTMT #6 (CBS 143057). Strain Q199 (CBS 143051) (high itaconic acid producing strain, derived from an industrial citric acid production strain) was co-transformed with hph splitmarkers to create ictA deletion strain Q199 ΔICT #4 (CBS 143050). In our fermentation experiments we saw that the highest producing strains also grew the poorest (see FIGS. 2, 3 and 5) due to toxic effects of itaconic acid or one of its degradation products on *Aspergillus niger* growth. Another ictA deletion strain was created in the industrial citric acid production strain background using a different route. First, strain CAD MFS #15 (CBS 143047) was created by co-transformation of strain AN39 pyrE #4 (CBS 143052) with separate expression cassettes containing cadA-amdS and mfsA. Next, a selected pyrE mutant of CAD MFS #15, namely CAD MFS #15 pyrE #8 (CBS 143048) was co-transformed with separate expression cassettes containing cadA, mttA, mfsA, citB, and the hph splitmarkers to create ictA (An07g00760) deletion strain transformant CAD MFS #15 MTT CITB CAD MFS ΔICThygB #21 (CBS 143049). Co-transformations of the splitmarker fragments and expression cassettes were performed with PCR products. Sequences of expression cassettes and transformations are described in Hossain et al., 2016, Microb. Cell Fact., 15:130. A selection of transformants was purified and analysed by diagnostic PCR for the disruption of the respective target gene and presence of transformed genes. Correct gene-disruption transformants were identified and used for further research.

Example 10

Improved Itaconic Acid Production

Itaconic acid producing *A. niger* strains carrying a deletion of itaconyl-CoA transferase (An07g00760) and/or itaconyl-CoA hydratase (An07g09220) and/or citramalyl CoA lyase (An01g08610)led to improved itaconic acid production by reducing/removing itaconic acid degradation and/or biochemical conversion. As can be seen in FIGS. 17 and 18 significant improved production of itaconic acid levels were observed in deletion strains of itaconyl-CoA transferase (An07g00760) or itaconyl-CoA hydratase (An07g09220) in both shaking and static flasks. Similar results were obtained with the ictA (An07g00760) deletion strain CAD MFS #15 MTT CITB CAD MFS ΔICThygB #21 (CBS 143049) that was created in the industrial citric acid production strain background using a different route.

Figure 17B:
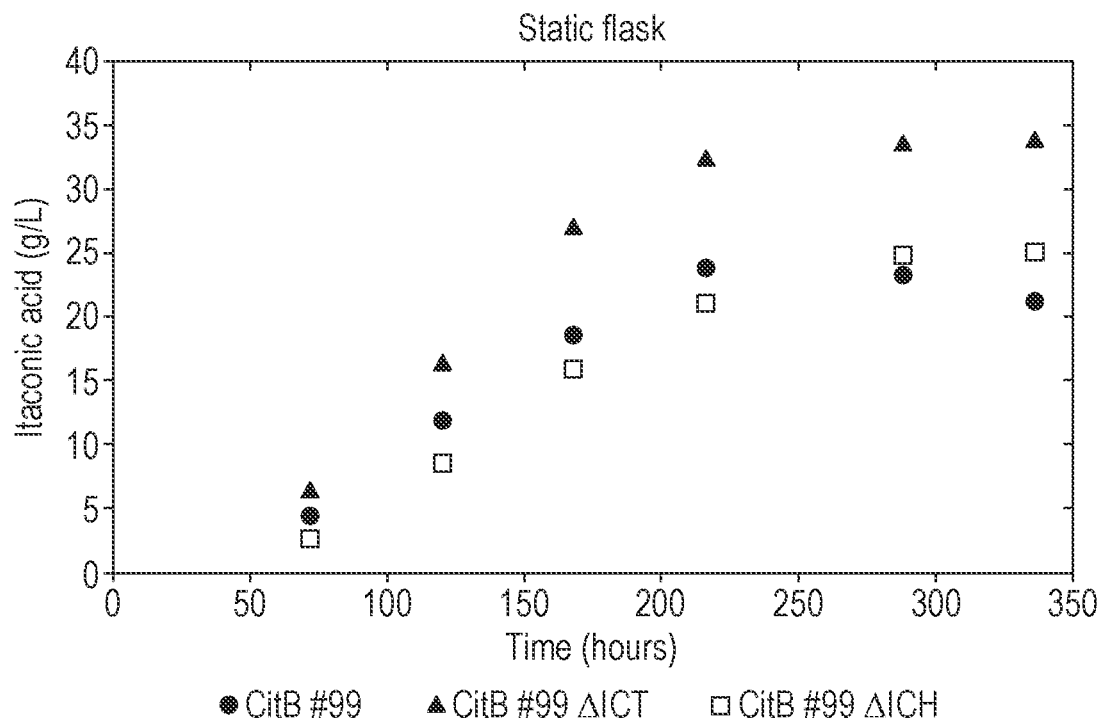

Deletion strains and their parental strains were cultivated in 500 mL Erlenmeyer flasks filled with 100 mL production medium. Medium composition is listed in Table 2 with the following modifications: 160 g/L glucose (FIG. 17) or 200 g/L glucose (FIG. 18) was used instead of 100 g/L glucose and 1.43 g/L NH4NO3 and 0.00058 g/L FeCl3*6 H2O were used instead of (NH4)2SO4 and FeSO4. Flasks were inoculated with $1.0*10^6$ (FIG. 17) or $1.0*10^5$ (FIG. 18) spores/mL and incubated at 33° C. (FIG. 17) or 35° C. (FIG. 18) in an incubator at 250 or 0 RPM (FIG. 17B). Organic acid levels (g/l) were obtained in time by HPLC analysis.

Controlled fermentation experiments were carried out with strains carrying a deletion of itaconyl-CoA transferase (An07g00760) or itaconyl-CoA hydratase (An07g09220). Controlled fermentations with deletion strain CitB #99 ΔICT #RD1 (CBS 143055) and deletion strain CitB #99

RICH #RB2 (CBS 143056) were performed as described in Example 3. However, the production medium (Table 2) contained 1.43 g/L NH4NO3 and 0.00058 g/L FeCl3*6 H2O instead of (NH4)2SO4 and FeSO4. Controlled fermentation with deletion strain Q199 ΔICT #4 (CBS 143050) (see FIG. 20) was performed as described for strain Q199 (CBS 143051) in Example 1, but with 200 g/L glucose instead of 160 g/L glucose.

Itaconic acid levels were determined from these fermentations and compared with similar samples from the parental host strain (see FIGS. 3 and 5). From FIGS. 17 and 19 it is clear that deletion of itaconyl-CoA transferase (An07g00760) improves itaconic acid production more than deletion of itaconyl-CoA hydratase (An07g09220), showing that omission of the whole degradation pathway is more beneficial.

Deletion of any of the three genes from the degradation pathway not only results in less or no itaconic acid degradation, but also less intracellular accumulation of pathway intermediates resulting in less inhibited growth in *Aspergillus niger*. Moreover, increased levels of itaconic acid are observed in these strains.

```
Nucleotide & Protein sequences
Coding sequences are highlighted.
itaconyl-CoA hydratase
>gb|ACJE01000009.1|: 2143350-2147500 Aspergillus niger ATCC 1015, whole genome shotgun
sequence (itaconyl-CoA hydratase Ich) An07g09220
CGTCCACTTGACTGTACTCAAGTCAACGACCAGAAAGGCGTCAAAAATTCAAGTAATTCAGCAAGAAAGA

CGTCTACTTGATATCAACATATCAACTTAAGAAAGAAGAAAGAGAGTGTGTGTGCGTGTGTGCAGGAAAC

AAGCCGACGAAACTGATTGTGTCTGATCGGAAGGCCAGGCAGGCAATAATGTTAGATGTCAAGCCCAAAC

AGGCAAAAATCAACGCGAAGGGGCTCATACGTCTTCCGTTTACACTATCTATTCAACAAGTTTACCATAC

CATTGAAAGTCATTAAATATAGGGGAAAGTTGAACAACGATGCTGCGGGTGCCGGACTATGGGACATGGG

AATGAACCAGAAGGTGGGGTACCCATGGATTATGTCCACCTGCTGCGGTCTTCAAGCGAGGTGCAGGGGG

CTGCTGGTACGAGGCAGTTTGTACTGGCAGTCTAATCTTGGCAAGAATCATCGGACAGCCAGCCGCGTCT

GACACCTATCAAGTGGTTTGGGCAGTTAAGTTTACGGAGAATCTGATTATCCTAACGCAAACCCTTTGCG

ATCGATACATTTATTACATGATTATATTAGGGGCATATATACTCTATGTCCATATATTTTGGATGATACT

CTCTGTAATGCCGATTCTTAGCGGGGTCTACCTACTACCATAGACACAAGGATTAGCTTATTTCATTACT

TAGTCGAGATGCGAGGGAATCCCGGAGTTTCTCGACAGAGGAATTCTCGACTCTTCTAGATCGCCTCGAC

AAGAACAAGAATGTAGGCCTACGGGAAATTTATGGCGCATCTGAGCATTGCTATAGGACTGTTATTTGAC

ATGAAGCTGCATTCCGCTACCACGCGGCTCCGGTAAGGGTAATATAAGTGCTGCTTATTTTCGGACCCTG

ATAGCCTTCAAGCATCACTGGTCTAGTGTACCCAGCGCCGGCGACGATGAGTGGATATATTCGCTGTGGC

AGTTAAAACGGTGCAGTATAGCCTACCTAAAATGTACAAGGCATCAACACCTAGTAGTGCCAAAAAAATC

ACGCTTTTATTTCAAAAGAGTACGCCTATCTTTAGTCTTTCCGCTGTCACCGACAACTACTCCGTAGTTC

AATAAGAAGTAGAACATCAATTATCAGAAACTCTTTCCTGACGGGGTTTCTATCTATTTACTACCGAATA

GTACTTTTAATATCTTGAAACCTGCTGAAGTCAGTACTACTGTGCCATAGAGAAAACAGGAAACCCCTCC

ACGCTCGGCGTCATTTCTCCCAGACCGAGAGAATGCGGCGGCTAAATGACGGCGCCGAAGCGACCCCATA

AAGGCTACTCGGAACATAGCCTCTGGATCCCGGTCTCGGAAATGCCCAGCGACCCGAGGTACAAAACCCC

AGCACTTCCGAGACAACGCCATGTTAAGCTCGCCTCTTCACTTCTTCCACGATCACTCGAACCACACTGA

AGCATTATTTCACTCTCAATTAAAATAACCATGTCCCTCCCCTCAATAACCCGCAGTTCCACACGAACCC

TCCTCCGCCCACAAACCGTCACACCCCAACTCACCCGCGCATTCTCCATCCGCCCAGCACTCCGCACCGA

CACCTCCGCATCCACTATTGCAACATCCTTCCTCACGCGCTTCCAATCCCTAGGCCCACAAACCCGCTCC

CAAATCCTCGATGCTAATCAACTCCGACTTCTCTCACTAACACTCAATCGACCCTCACTATTCCCCAACT

CCCCATCTCTCTCCAACACCCCAACCTCCCTGCCGACCGGCACGCCCTTACCCGCCGGATACCACCTCGT

GTACTTCACCCCCGCATTCTTGGAAAATGAGCTAGGCGCGGACGGCACCGACACCTCATATAACCCTGCG

TCGCCGTTCACGCGTCGCATGTGGGCCGGCGGGGAGGTGCATTGGCCGAGGGGAAAGGACGGCAAGCCGA
```

ATTACTTAAGGGTAGGGCAGGAGGTGCAGGAGACGACGAGGGTGCTTAGTGCGGAGCCGAAGGTCGTGAG

GAAGACAGGGGAGGAGATGATTGTTGTGGGTGTAGAGAAGGAGTTTAGGAATGAGGATGGGGTGGCGGTT

TTGGATAGGAG*GTGAGCTGATCTGCTATCTATTTGTTTTGTGAGTTTGGGGATAGTGCTGATGAGACTAT*

*ATGTAGGAACTGGGTCTTTCGCAAAGCTCTTACCTCGCCGTCGCCTACGAGTTCATCTACACCCCCGGCG*

ACGAAGGCATTTAATGGACCAGCTAGTTCGTCTACGGAGACGAGTGAAAATGTGCACACGCGCACATTGC

GCCAAACGGCAGTGACATTGTTCCGGTTCTCCGCGTTGACGTTCAATCCGCACAAGATCCATTACTCGAC

ACCGTGGGCGAGAGATGTCGAGGGTCATAAGGATATTGTTGTGCATGGACCGTTGAATCTCATTTCGATT

TTGCATCTGTGGCGCGATACGAGGAAGAATGGAAGTGGGGAGGAGGTGGTTCTTCCGGAGAAGATCTCGT

ACAGGGCGACGAGTCCGCTGTATGCGGAGGAGGAGTATCGGATTGTGTTGGAAGATGGAGAGGATGGGAT

CGGGAGGGTGCAGATTGTTGCGCCAGGGGAGGTGGTGGCTATGAAGGCGGAGATTCAGTAGAAATCGTGT

AGTTAGTAGGAGTGGGTTGTAGATATTGTCTGTTTCTAGCTGGGAGGGATACATGTATGGGGTGCTACAC

AAGAGTACTAAATGACATACCCTGAGATAGAAATAGTATAGGAGTTATCTACTGTATAGTACTACCCTTT

TGAACAAGTACCGAATCTTCAATTCTATATAACTTATCTGCTCCACTTCATTCTTAAAGTATGGTTCGGA

CTTATCTTCGGAGATAACCACTCCACCCCCATCCTTATCGCCATCACGGCAGCCTTCCATTCCACTTCAA

TCCGACACTCAACTCAACTTCACATCCACTATTTATCTATCGACCACAACTACCCCACCCTCCACACATC

TCCCCTGATACTCGGTACATACTAGACCCACTATATACTCCACTGCCCAACGACACAGACCGAACAAGAA

CAGACATGGAAAAGAAACGCACCCGCGTTCAACTCTCCTGCACTGCCTGCCGAGCCCGCAAGTAAGCACG

CGGCAACCCCGCCCCTCTCCCTATCTCACATTCCTCCTTCTACCTCCAATCACTGGCGCCTACTACTCCA

TACGCCACTCAATCTGATGATAATAACCCATGCATTAGGCTAAAATGCTGTCGTACCCACCCCTGCACAA

ACTGCCTGAAGCGCAACGAAGCCGGCACCTGCACCTTCGTCGGGCGCGGTCCGCGCGGCAAGATTTCGAG

TAATGGACGAACCAGCCCGGCGCACGTTCAGGATCGATTACAACACTTGGAGAATTTGATTTTGTCGTTT

ACGCAGCAGCAGCAACAGCAACAGCAGGAGAAGCCGGATAGTGTGGGCGAACACCAACAGGTTATTAATA

ATGGTGGTCAGATCACGCCGGCATCGTCGGTGCCACCATCATTATCATTTGGGGACGTGCAGCAGGCACA

GAAGGAGGGGGAATCGGAAACTCCGCCTCCTGATCCCGGGAGGTTGGTCGTTAGGGAGACCGGAATGAGG

TATATTGATGGAGCGCATTGGACTGCGATTCTCGAGGAGGTAAGAGCAGTCTTTTCGAGTAATTGGGGAG

TTAGATTGGGTGGGGGCTGATGACGTGCAGATTAGCGGGGTTAAGGAGTATCTAAGGGATAACGAGGAGA

TGGGATTGTCGGACGAGGAAGGGGAAGATGAGGAGATGGTGAGGCCGTCGAATGCGCCAACGCTATTACT

TGGGTTGCACCAGGAAATGACTATGGACGAGTTGTTGGACGGGTTGCCGGCTCGGCCGGTCGTGGATCGG

GTCGTGGCTATGTTTGTCAGCCTTAATGAGCCGACGACAGGTAGGTGTCGCTGTTATATCGATCCTTAAT

AGGTGGTGCTGATAGGGTTAGTGATGTGCACTTTCCTACTTTCCAGAAACAGGTATGCTAGCTCAATCT

AGTGGGAAATATGTAGAGGATGCTGCTGACGTGCGCAGTATAATCAATTCTGGTCAAGACCAAAGGAGGC

TTCCATTTCTTGGCTGGCACT (SEQ ID NO: 22).

>gi|350635935|gb|EHA24296.1|hypothetical protein ASPNIDRAFT_180396 [*Aspergillus niger*
ATCC 1015] (An07g09220: Ich) mito: 23, cyto: 3
MSLPSITRSSTRTLLRPQTVTPQLTRAFSIRPALRTDTSASTIATSFLTRFQSLGPQTRSQILDANQLRL

LSLTLNRPSLFPNSPSLSNTPTSLPTGTPLPAGYHLVYFTPAFLENELGADGTDTSYNPASPFTRRMWAG

GEVHWPRGKDGKPNYLRVGQEVQETTRVLSAEPKVVRKTGEEMIVVGVEKEFRNEDGVAVLDRRNWVERK

ALTSPSPTSSSTPPATKAFNGPASSSTETSENVHTRTLRQTAVTLFRFSALTFNPHKIHYSTPWARDVEG

HKDIVVHGPLNLISILHLWRDTRKNGSEEVVLPEKISYRATSPLYAEEEYRIVLEDGEDGIGRVQIVAP

GEVVAMKAEIQ (SEQ ID NO: 23).

```
          M   S   L   P   S   I   T   R   S   S   T   R   T   L   L   R   P   Q   T   V                F1
   1  ATGTCCCTCCCCTCAATAACCCGCAGTTCCACACGAACCCTCCTCCGCCCACAAACCGTC                                       60
      ----:----|----:----|----:----|----:----|----:----|----:----|

T   P   Q   L   T   R   A   F   S   I   R   P   A   L   R   T   D   T   S   A                F1
   61 ACACCCCAACTCACCCGCGCATTCTCCATCCGCCCAGCACTCCGCACCGACACCTCCGCA                                       120
      ----:----|----:----|----:----|----:----|----:----|----:----|

S   I   A   T   S   F   L   T   R   F   Q   S   L   G   P   Q   T   R   S                    F1
  121 TCCACTATTGCAACATCCTTCCTCACGCGCTTCCAATCCCTAGGCCCACAAACCCGCTCC                                       180
      ----:----|----:----|----:----|----:----|----:----|----:----|

Q   I   L   D   A   N   Q   L   R   L   L   S   L   T   L   N   R   P   S   L                F1
  181 CAAATCCTCGATGCTAATCAACTCCGACTTCTCTCACTAACACTCAATCGACCCTCACTA                                       240
      ----:----|----:----|----:----|----:----|----:----|----:----|

F   P   N   S   P   S   L   S   N   T   P   T   S   L   P   T   G   T   P   L                F1
  241 TTCCCCAACTCCCCATCTCTCTCCAACACCCCAACCTCCCTGCCGACCGGCACGCCCTTA                                       300
      ----:----|----:----|----:----|----:----|----:----|----:----|

P   A   G   Y   H   L   V   Y   F   T   P   A   F   L   E   N   E   L   G   A                F1
  301 CCCGCCGGATACCACCTCGTGTACTTCACCCCCGCATTCTTGGAAAATGAGCTAGGCGCG                                       360
      ----:----|----:----|----:----|----:----|----:----|----:----|

D   G   T   D   T   S   Y   N   P   A   S   P   F   T   R   R   M   W   A   G                F1
  361 GACGGCACCGACACCTCATATAACCCTGCGTCGCCGTTCACGCGTCGCATGTGGGCCGGC                                       420
      ----:----|----:----|----:----|----:----|----:----|----:----|

G   E   V   H   W   P   R   G   K   D   G   K   P   N   Y   L   R   V   G   Q                F1
  421 GGGGAGGTGCATTGGCCGAGGGGAAAGGACGGCAAGCCGAATTACTTAAGGGTAGGGCAG                                       480
      ----:----|----:----|----:----|----:----|----:----|----:----|

E   V   Q   E   T   T   R   V   L   S   A   E   P   K   V   V   R   K   T   G                F1
  481 GAGGTGCAGGAGACGACGAGGGTGCTTAGTGCGGAGCCGAAGGTCGTGAGGAAGACAGGG                                       540
      ----:----|----:----|----:----|----:----|----:----|----:----|

E   E   M   I   V   V   G   V   E   K   E   F   R   N   E   D   G   V   A   V                F1
  541 GAGGAGATGATTGTTGTGGGTGTAGAGAAGGAGTTTAGGAATGAGGATGGGGTGGCGGTT                                       600
      ----:----|----:----|----:----|----:----|----:----|----:----|

L   D   R   R                                                                                 F1
  601 TTGGATAGGAGGTGAGCTGATCTGCTATCTATTTGTTTTGTGAGTTTGGGGATAGTGCTG                                    660

----:----|----:----|----:----|----:----|----:----|----:----|

N   W   V   F   R   K   A   L   T   S   P   S   P   T   S                F3
  661 *ATGAGACTATATGTAG*GAACTGGGTCTTTCGCAAAGCTCTTACCTCGCCGTCGCCTACGA                                 720
      ----:----|----:----|----:----|----:----|----:----|----:----|

S   S   T   P   P   A   T   K   A   F   N   G   P   A   S   S   S   T   E   T            F3
  721 GTTCATCTACACCCCCGGCGACGAAGGCATTTAATGGACCAGCTAGTTCGTCTACGGAGA                                       780
      ----:----|----:----|----:----|----:----|----:----|----:----|

S   E   N   V   H   T   R   T   L   R   Q   T   A   V   T   L   F   R   F   S            F3
  781 CGAGTGAAAATGTGCACACGCGCACATTGCGCCAAACGGCAGTGACATTGTTCCGGTTCT                                       840
      ----:----|----:----|----:----|----:----|----:----|----:----|

A   L   T   F   N   P   H   K   I   H   Y   S   T   P   W   A   R   D   V   E            F3
  841 CCGCGTTGACGTTCAATCCGCACAAGATCCATTACTCGACACCGTGGGCGAGAGATGTCG                                      900
      ----:----|----:----|----:----|----:----|----:----|----:----|

G   H   K   D   I   V   V   H   G   P   L   N   L   I   S   I   L   H   L   W            F3
  901 AGGGTCATAAGGATATTGTTGTGCATGGACCGTTGAATCTCATTTCGATTTTGCATCTGT                                      960
      ----:----|----:----|----:----|----:----|----:----|----:----|

R   D   T   R   K   N   G   S   E   E   V   V   L   P   E   K   I   S   Y                F3
  961 GGCGCGATACGAGGAAGAATGGAAGTGGGGAGGAGGTGGTTCTTCCGGAGAAGATCTCGT                                      1020
      ----:----|----:----|----:----|----:----|----:----|----:----|
```

```
          R   A   T   S   P   L   Y   A   E   E   E   Y   R   I   V   L   E   D   G   E                    F3
1021 ACAGGGCGACGAGTCCGCTGTATGCGGAGGAGGAGTATCGGATTGTGTTGGAAGATGGAG                                         1080
     ----:----|----:----|----:----|----:----|----:----|----:----|

D   G   I   G   R   V   Q   I   V   A   P   G   E   V   V   A   M   K   A   E                    F3
1081 AGGATGGGATCGGGAGGGTGCAGATTGTTGCGCCAGGGGAGGTGGTGGCTATGAAGGCGG                                         1140
     ----:----|----:----|----:----|----:----|----:----|----:----|

I   Q   *                                                                                         F3
1141 AGATTCAGTAG                                                                                          1151
     ----:----|-
```

>gb|AAJN01000104.1|: 124953-128107 *Aspergillus terreus* NIH2624 cont1.104, whole genome shotgun sequence (ATEG_03709: Ich)

TGGCTGGGCAAATGTTTGACGAAATCGAGACCGTCAGATGATCCTGGCTGGTATGTGCCTGTGCATGCT

AAACTGTATTCAGCCTTGGAGATAACATGCTAAGTAGGATGTGATTAAAATTGCCTCGTCCTCGCATGTC

AGGCATAGTTATCGATTGTGTCGTGCAAGTAAAGTAGTTCTTGGTTGGGACGATCCGACGATCACAAACG

CCTTATCACGGAGAAGCAAGGAGGCCATATTGTGATGCGCCACACTAAGCAGGAAGATAGTAAAACAAGG

TATGGCCCGCCACATGCCGAAGTTGGCTCAGTTGAGTGGTCATTAAGATATCGCCGTCGAGATAGTACGA

TGCCCCTTCTGGCCGTCAATCACGGGTGCGCTGTTTCTTCGTCGGATGCATAGCCTGTCTTCTGAGATTC

TCTGTTGAAGCCTCGCTTTTAAGGGTGTCTGATGGACAGACGAGACTTTGGTCCTCTGTCACAATGCATC

TGGGGGGTCTGACGATGTGACAGTCCTGATGCACTCGACCAGAACGGACCACAGGTGATGTAATGCGAAG

AAGCTCATGGAAATGGCTCAGGGTGGTCATCTGGCCTCATTCTCCTCTGCAGCAGTCCATGATAGACAAT

AAATGATGTGTTGATATGCGATCACACTTATAATAGTGGCCCAGCATACAGCCGACTTGAAAGAAGCCGA

AGAAGCCGCATCGGCTACCTGCAGTCACAGCGTTGCTCAACAGGGCTTCGTAAGGTCGCGACTGTCGGAG

AAATATCTCGAGAATAATGACTCACGATGCTGACGTGACCAGTTTAACATCCTAAGATGCGTGAAGAAG

AGTTGGTTGCGACGAGAGGATGTCCCGGAAAGGTTAGCACCTCGGCTACTTGGGATCTCCCCGTTCTCCA

CTCGTCGTACTTCCTGCCCTCACTACTGCTATAAATTCTCCCATTGAACCTCATCGGGGTGTTGATGGTT

GTCAAAATCATCTCGGCATAATGTCGATCCATACATCCGCTCGTTGGGCCATGCGATCTGTCCCTCCGCT

GACGCAGGGATGCGCTGCACTTCGCCGCTTTTCCGTCCAGCATTCATGCCGATCAGCACCTGAAGCTACC

GCTCCCTCCGTTGCAGCTTCCTTCCTTTCGCGATTCCAATCTATGGGACCACAGACTCGCTCGCAGGTAC

TCGATGCCAACCAGCTACAGCTTCTATCTCTCACCTTGAACCGACCCTCTCTTTACCCGAACTCTCCATC

GCTGTCGAATGCCTCTGGTGTCGTGCCGACAGGTACGCCCTTGCCCCCGCCTACCATCTAGTCTACTTC

ACCCCTGCATTCCTGGAGGGTGAGCTGGGTGCCGACGGAACCGATGTCTCTTATAACCCAGAGCCGCCCT

TCACGAGGCGCATGTGGGCCGGCGGTGAAGTTCAATGGCCTCGAGGGGCAGACGGAAAGCCCAACCCATT

GCGTGTCGGGCAGGAGGTTCAGGAAACCACGCGGGTGCTCAGTGCGGAGCCTAAGATCATTCGTAAGACT

GGAGACGAAATGATTGTCGTGAGTGTAGAGAAAGAGTTCCGTAATGAACACGGCGTGGCTGTTATCGATC

*GTCGGTAGGTTTTACGCATACCTCATGTACGTCAAGTTACATTGTACGGCTAATCAATTATGGTCAGAAA*

CTGGGTTTTCCGCAAAGCCTTGGCTTTGGCATCATCACCGGTTTCAGCTTCTCCAATCTCTGTTCACTTA

CCCGCATTGCCCGCATCTTGCTCTACCTCCACCGTGGGAAAGACTCACACTCGCACTCTCAGGCAAACAG

CCGTCACTCTCTTCCGCTTCTCAGCCTTAACTTTCAATCCCCACAAAATTCATTACTCCACTCCGTGGGC

TAGGGATGTGGAAGGCCACAAGGATATTGTCGTTCACGGCCCCCTAAATCTGATCTCGATTCTGGATTTG

TGGAGAGATACCCGGGCGGATAGCGCCACCGACTCATCCTTATTGCTCCCAGAGAGTATCTCTTATCGCG

CCACCAGCCCGCTGTATGCCGAAGAAACGTATCGGATCGTGCTTGATGAGGAGCAGGGTGACGGTGTGAG

CCGAGTACAGATCTTCACGCCGGATGAGAAGGTGGCCATGAAGGCTGAGATCAGATGAACCAATAGACAT

AACTCGACGCTTGGATTTTCTGTATATATGGTCAGACGACACGAAATACATCGTTTTCCTCGGCTCGACT

TACAGACTAGACTTCAGCTGCTGCCAGATGCTGGCCGAGGGGCTCTGAGCTTAAGTTCTTATACTTCATG

TCGAGTACGTCTTGTTTTTCATTTGGACCAGACACTAACTCCAGATATGGGTGGAAATATACTAACCGAT

GCTATTCTTGCCTCCGCCCCAATAACATTTCTCTGGATAGGAAATGGACCTTAAAAGGAAGATCAGTCTG

TCGGTGCTTTTAGGACTGGGTTCCCCGTATGTCGATGCCTTGAATTTTGAGCTAAAACGTTTTTGGTAAA

ACTTGATGTTGGATCACGAAGTACTACATCAATAGACCCTTTCAGTTCACTATATATCTTCAGGAGCTAG

CAAGGGTTGTTGGCTCGATACCTGAAGAGTTACGGACTACACTGTGTTTCTTTCCCTGGATGGACGCGAC

CATCAGTTGATATGAGACAGTGCTTGATTATCTTACTTTTCCTGATTTTTTCGACTGTCCCTGTGTATTT

AGGAGCCAATGCCTAGGTTTCGTGTCATTCATAGATATAGGTTTTGTGTGGTAATGAATGATTGCCCCTG

TTATAGGACGTGTGTGAGGGGAATATATATCACACGAGAATCTTTGGGACACCGAAGAGTTACAAATCTA

ATTATGCTACCTAGTAGCTATAGATCTAGTCTAGTAATGAGTGCTTACTTTGAAGACCTACATGGCGTAG

TCCAGTCTGATACTGTGTGGGAGACTTCGTCCGGACTTAGTAGCGGAGATAATCAACCCAGACCGAAGTC

TCGTATATGAATCTCACCTGATCTCACCCTTTGTCTTTTCTCCCAATCCCGCCTCCTTCAAGACATATCA

TAACAGCCGAAGCGCAGACTGAAAATGGCAGACACGACCAGTGGCGCTGTACTTTCTCCCAAAGAAAGA

AGAGG (SEQ ID NO: 24).

>gi|114193811|gb|EAU35511.1|conserved hypothetical protein [Aspergillus terreus
NIH2624] (ATEG_03709: Ich) mito: 23.5, cyto_mito: 13.5
MSIHTSARWAMRSVPPLTQGCAALRRFSVQHSCRSAPEATAPSVAASFLSRFQSMGPQTRSQVLDANQLQ

LLSLTLNRPSLYPNSPSLSNASGVVPTGTPLPPAYHLVYFTPAFLEGELGADGTDVSYNPEPPFTRRMWA

GGEVQWPRGADGKPNPLRVGQEVQETTRVLSAEPKIIRKTGDEMIVVSVEKEFRNEHGVAVIDRRNWVER

KALALASSPVSASPISVHLPALPASCSTSTVGKTHTRTLRQTAVTLFRFSALTFNPHKIHYSTPWARDVE

GHKDIVVHGPLNLISILDLWRDTRADSATDSSLLLPESISYRATSPLYAEETYRIVLDEEQGDGVSRVQI

FTPDEKVAMKAEIR (SEQ ID NO: 25).

```
        M   S   I   H   T   S   A   R   W   A   M   R   S   V   P   P   L   T   Q   G           F1
    1 ATGTCGATCCATACATCCGCTCGTTGGGCCATGCGATCTGTCCCTCCGCTGACGCAGGGA                              60
      ----:----|----:----|----:----|----:----|----:----|----:----|

C   A   A   L   R   R   F   S   V   Q   H   S   C   R   S   A   P   E   A   T         F1
   61 TGCGCTGCACTTCGCCGCTTTTCCGTCCAGCATTCATGCCGATCAGCACCTGAAGCTACC                              120
      ----:----|----:----|----:----|----:----|----:----|----:----|

A   P   S   V   A   A   S   F   L   S   R   G   Q   S   M   G   P   Q   T   R         F1
  121 GCTCCCTCCGTTGCAGCTTCCTTCCTTTCGCGATTCCAATCTATGGGACCACAGACTCGC                              180
      ----:----|----:----|----:----|----:----|----:----|----:----|

S   Q   V   L   D   A   N   Q   L   Q   L   L   S   L   T   L   N   R   P   S         F1
  181 TCGCAGGTACTCGATGCCAACCAGCTACAGCCTCTATCTCTCACCTTGAACCGACCCTCT                              240
      ----:----|----:----|----:----|----:----|----:----|----:----|

L   Y   P   N   S   P   S   L   S   N   A   S   G   V   V   P   T   G   T   P         F1
  241 CTTTACCCGAACTCTCCATCGCTGTCGAATGCCTCTGGTGTCGTGCCGACAGGTACGCCC                              300
      ----:----|----:----|----:----|----:----|----:----|----:----|

L   P   P   A   Y   H   L   V   Y   F   T   P   A   F   L   E   G   E   L   G         F1
  301 TTGCCCCCCGCCTACCATCTAGTCTACTTCACCCCTGCATTCCTGGAGGGTGAGCTGGGT                              360
      ----:----|----:----|----:----|----:----|----:----|----:----|

A   D   G   T   D   V   S   Y   N   P   E   P   P   F   T   R   R   M   W   A         F1
  361 GCCGACGGAACCGATGTCTCTTATAACCCAGAGCCGCCCTTCACGAGGCGCATGTGGGCC                              420
      ----:----|----:----|----:----|----:----|----:----|----:----|
```

-continued

```
             G  G  E  V  Q  W  P  R  G  A  D  G  K  P  N  P  L  R  V  G                    F1
    421 GGCGGTGAAGTTCAATGGCCTCGAGGGGCAGACGGAAAGCCCAACCCATTGCTGTGTCGGG                       480
        ----:----|----:----|----:----|----:----|----:----|----:----|

Q  E  V  Q  E  T  T  R  V  L  S  A  E  P  K  I  I  R  K  T                    F1
    481 CAGGAGGTTCAGGAAACCACGCGGGTGCTCAGTGCGGAGCCTAAGATCATTCGTAAGACT                         540
        ----:----|----:----|----:----|----:----|----:----|----:----|

G  D  E  M  I  V  V  S  V  E  K  E  F  R  N  E  H  G  V  A                    F1
    541 GGGAGACGAAATGATTGTCGTGAGTGTAGAGAAAGAGTTCCGTAATGAACACGGCGTGGCT                        600
        ----:----|----:----|----:----|----:----|----:----|----:----|

V  I  D  R  R                                                                  F1
    601 GTTATCGATCGTCG*GTAGGTTTTACGCATACCTCATGTACGTCAAGTTACATTGTACGGC*                       660

----:----|----:----|----:----|----:----|----:----|----:----|

N  W  V  F  R  K  A  L  A  L  A  S  S  P                          F1
    661 *TAATCAATTATGGTCAG*AAACTGGGTTTTCCGCAAAGCCTTGGCTTTGGCATCATCACCG                       720
        ----:----|----:----|----:----|----:----|----:----|----:----|

V  S  A  S  P  I  S  V  H  L  P  A  L  P  A  S  C  S  T  S                    F1
    721 GTTTCAGCTTCTCCAATCTCTGTTCACTTACCCGCATTGCCCGCATCTTGCTCTACCTCC                         780
        ----:----|----:----|----:----|----:----|----:----|----:----|

T  V  G  K  T  H  T  R  T  L  R  Q  T  A  V  T  L  F  R  F                    F1
    781 ACCGTGGGAAAGACTCACACTCGCACTCTCAGGCAAACAGCCGTCACTCTCTTCCGCTTC                         840
        ----:----|----:----|----:----|----:----|----:----|----:----|

S  A  L  T  F  N  P  H  K  I  H  Y  S  T  P  W  A  R  D  V                    F1
    841 TCAGCCTTAACTTTCAATCCCCACAAAATTCATTACTCCACTCCGTGGGCTAGGGATGTG                         900
        ----:----|----:----|----:----|----:----|----:----|----:----|

E  G  H  K  D  I  V  V  H  G  P  L  N  L  I  S  I  L  D  L                    F1
    901 GAAGGCCACAAGGATATTGTCGTTCACGGCCCCCTAAATCTGATCTCGATTCTGGATTTG                         960
        ----:----|----:----|----:----|----:----|----:----|----:----|

W  R  D  T  R  A  D  S  A  T  D  S  S  L  L  L  P  E  S  I                    F1
    961 TGGAGAGATACCCGGGCGGATAGCGCCACCGACTCATCCTTATTGCTCCCAGAGAGTATC                         1020
        ----:----|----:----|----:----|----:----|----:----|----:----|

S  Y  R  A  T  S  P  L  Y  A  E  E  T  Y  R  I  V  L  D  E                    F1
   1021 TCTTATCGCGCCACCAGCCCGCTGTATGCCGAAGAAACGTATCGGATCGTGCTTGATGAG                         1080
        ----:----|----:----|----:----|----:----|----:----|----:----|

E  Q  G  D  G  V  S  R  V  Q  I  F  T  P  D  E  K  V  A  M                    F1
   1081 GAGCAGGGTGACGGTGTGAGCCGAGTACAGATCTTCACGCCGGATGAGAAGGTGGCCATG                         1140
        ----:----|----:----|----:----|----:----|----:----|----:----|

K  A  E  I  R  *                                                               F1
   1141 AAGGCTGAGATCAGATGA                                                                   1158
        ----:----|----:---
``` itaconyl-CoA transferase
>gb|ACJE01000009.1|: 151257-155510 Aspergillus niger ATCC 1015, whole genome shotgun
sequence (itaconyl-CoA transferase Ict) An07g00760
ACAGGGCAGCGGACTTCATGGACTACGGCAGGCTGCGCCGGACATTGGGACGTGTTCATGCGACACTTGA

TTCATATCGACAGCGGGCAATATGATTCGCTAATATACCCTTCACGGCCAGTCCTCAGTTTGGCCTAGAT

TTACAATTCCGTCCGCACTAAAGAATGCAGACCGAGTATTGACTTGGGCATCAGTTCTGCTCAGGTCATA

GCACAAATGCTTCTGATCGGAGAATTTCGGATGTATCCGAAACATCTGCTTGCGGCTGCACACCGACATG

AAAAAGGCACGTCTCATTCATCGGAATATTCCCCGTCTCAAAGTTGGTGACGTGAACGGCACATTAACCC

CACCAATCAGACGCCAGGGAGGCCTGATGCTAGCCCGATGATCGTCAAGCGAGTTCCCTGGACGATGCCG

TCCTCCCCGATGGAACAGCCATTATCCATCTGCTGGATGGGAATACTAGCCCGTTGAACCGAGCTACTTC

AGGAACAGATGTTCAAGTGTGACCTTCCCGTCTTTAAGTAGTATAGCTTCACAATTGGGGGTTAAGGCTG

CTTGTGTCCCTTGTAAGTGACCGACATCAGCAATGGCCGTTATGACGACCCTCCGGTATTTGGTCGCATA

CGAGGTGCAGTAGTACAGCATATTAGACCAAAAGCCTCCAGGGTGCTTGCATTGGGATGAACATCGTCCA

GGATCACCTCCGGCGGTATCCAGCAGGTGTTCAGCCGAATAGCCCCGTGGCTGTATTTGGCAGGGAGTAT

CCTTGTCGGTTTGCATATAGGTAGCTGTCTAGAACTTGTGAGTTCGAGCTGCGCAGTTATATGGGTGATC

```
GTTTTCCAAGTGGCATGCTAGCGACGTGGCTGGAATAAGCTATGGTCACCAGGCCTCATAGCACATTGCT

CCTTCGTAATGCGGCAATTCAATTCCTATATAACCTTTCTAAAGCCCTCGCTACGATCAGAAATAAGCAG

GCCGTGATTGAATTCTGGTAGTAGACCTTATGCGACCGCGCGAAATTAGTAACCGAATCATTGATGGATT

GACTGCGAGATGGAGATTCCAGTATCATTCCTACAACCATGCTCAAGCTGGGAAAAGCTGTGAATGAACA

ATTAGCAGAAGATAGGCCGTGATCAAGCCTTGAGATGCAATGAATAGCAAAATGTTTCAATACCTGCTA

TCACAATCTTTGCAGACAGATTGTTACTAGGGTGGAAGGATATCTAGTTCTTTGGGAACAACACACTTTG

CCTGATACATATCTTCTGGAGATTTCATTGTTCTTCTGGAAAATGATCAGGGCAGGACTTTCATCCTCTT

ATAGTACATCATCTCCCAATAAACTAATGGTGGGACCGAGGCCAGCCCGGGGCATATAACCGACCCCAGA

GAGCCCGCGACCCCACGGTCGGCGACGTTCTCCGGTCGACGATGGCCTCAAAAACCGGGGTCATCCCCCA

CGAAAATATCCCCAATTCACAACCAGCACCATGCCTAACACCCGTCCCCTTGTCCGTGCGGCATGCCATA

ATCTCTCCGGATGCGCCATGCTTCTACTAGCGCCACGAAAAAGGCTGGCCCCTCGCCGGCATCACTGT

CGTCAGTCTGGAACAAGCCATAGCCGCTCCCTTCTGTACCCGCCAACTAGCCGACCTAGGAGCCCGAGTC

ATCAAAGTCGAACGACCTGGCGTCGGAGACTTTGCTCGCAATTATGACACCCGCGTTAACGGCCTAGCCT

CCCACTTCGTCTGGACCAACCGGTCTAAAGAGAGTCTCGCCTTGGACCTCAAAAAGCCGTCCGATCACAG

CGTGCTCATGCGCCTGCTCGGCCGCGCCGATGTCCTCGTCCAGAACCTCGCTCCCGGCGCCAGTGCTCGA

CTGGGTTTATCCTACGATGATCTCAAAGCGGCTCATCCATCCTTGATTGTGTGCAACATCTCCGGGTATG

GTCCTGACGGACCGTACCGCGATAAGAAGGCCTACGATCTGTTGATCCAGAGCGAGGCTGGCATGCTCTC

CGTCACGGGGACGGGAAAAGAGCCCGCCAAGGTGGGCATCTCCATCGCTGATATTTCCGCTGGTAGCTAT

GCCTACTCCAATATCCTGGCGGCGTTGTATCAGCGGGAGAGGGATCCCTCGAAGCGGGGGTGTAACATTG

ATATCTCCATGTTGGAGAGCATGGTTGAGTGGATGGGCTTCCCTATGTATTATACTTATGAGAATGCCCC

GGGCCCGACACCAGCGGGTGCTTCGCATGCGGCTATCTATCCTTATGGCCCGTTTGAGACGGGAGATGGA

ACGGTGATGTTGGGGATCCAGAATGAGCGTGAGTGGGCTAAGTTCTGTGACATCGTCTTGGGTCAACCCA

GTCTTGCTACGAATGAGCGGTTTGTGAATAACTCGCTGCGCTCGCAGAACCGTGATGAGTTGAAGAAGAT

AATCTGTGACGTCTTCTCGTCGCTTTCGGCGGAGCAGGTGATTGCTCGACTGGATGCAGCGGCGATTGCT

AATGCCAGCGTCAATGATATGCAAGGCGTCTGGAACCACCCACAGCTCAAGGCTCGGCAGCGATGGACAG

ATGTTAAGACGCCCGCAGGAAGTGTGCCGGCTCTGCTACCTCCTGGAATGACCATGGGGATGAGGATAC

TTATGGGGCGCGCATGGACGCTGTCCCTGATGTGGGTGAGCATAACAAGGCTATTCTGGCCGAGTTGGGG

CTCGACGAGGGTACGGAGAAATAGCTGCAGTTGAATTAATGACATGTACAGTTGAGCTAGTGGACTTGGC

TATCCTTGCGAGTATTGGAACTTTTAGGCCCTTTGTAAATAACTCAGTGCGATGGATTCACCTCGGGCAA

TTCTACTGTCCACTCACGAGGTTGAAGATACCTGCATGTCAAAGGATGTTCAGACGTAGAACTAGTCGAC

CACAATATGGATCTTACAGTTTAATCCAATTCAGGCAACCTACCCCTGCTGCCCCTAATATCACCCCGCG

ACGGTATCCAGCGTAAAGTGAATATCGGCGCAATATACCCATCGCCGAAGCAAGTGGATCGGGAAAACAG
```

```
GCAAAAAGCCGACATGCCCGCCAAGACCGAGGCAGCATAAAGCCGCTTTATCCTCGACTACGGCTACTTG

CATTCTGCCTGGCCACCTCTGAACTCCACTGTGGACGATCTCTTTCATTGGTAATTGGAGCTAATTCGAG

GATCATGTCCAGTCAGGAGTCATCGGGCCACCGACAGGTAAGAACCAGGGCCAAGCAGGCTTGTCTCCAC

TGCAATAAGCGGCGAATCCGCTGCAATGTGCTACAGATGCGCCCATGCCAGAATTGTCTGGCATTGAATG

TACCCTGTGAGATAGGCGTTTCAAAGCGAGGAAAGTATGTTTTCACGGTTTCGTCATTATGGTAGTTTGG

CGTAGACTGATTCAATGGCTTAGGTATCCCCGTAAGAAGAGTGCTCGGCAACAAACCGACGGCAACTCGG

TCCAATTGCCGGCATCATCTGCGAAGGGAGGGAACCATTCATTCACCGTGTCAGCAGGTGATAAATCCGA

CGCAAAAGAGTCGCATGTTCACCCGATACCAGGGGATGCTGCGAGTGCGCATCCAACAGTGTTCTTTGGT

GAATCGAGTCCACTCACTGTAGTGATTGACGAAGGGCGCCGGTCGCCTGAAAAGGGAACTAATGAGATGC

ATATGACTCGCTTTCATTATGCCATTCCTGAGAAACTTGATGCCTTCAACACCCGTGATGAGGCTTTCCG

AGCACACAAGATCAAGCAGGAAGGCCAGCTGAGAGCTGATGGGGCCTTCTCGTACCCGCCGCCAGAGACA

TGCGAAACTCTTCTGCGGGCGTACTTTGACTGGTTTCACCCCTGTTTCCCAATCCTTGATTGTGCTGCGG

TGTATGAGAGCTATGTGCAGGGGAGCATGTCGCCCCTCTTACTCCAGGCGATACTGTTCATAGGCGTCAG

CCTTTGCACGGATGAGGTGTTTGCCCGGACGGAGTTTTCTGTTCGATACTGGGCCAAGTTTCTCTTTTAC

AGCCGAGCAAAGGCAATCTACGATGCTGAATGGGAGTCTAACAAGACGGTCAAGATTCAAGCGCTGTTTT

TGTTGAGCTTCTGGCGTGGAGGACCATCTGAGGAGCGGGACATTCGATTCTGGCTTGGCATTGCCATTGA

CCTGGCACAAAAGCGCGGCATGCATTTGATGTATGTATTCTTTTGTCTTACCCT (SEQ ID NO: 26).

>gi|350635343|gb|EHA23704.1| hypothetical protein ASPNIDRAFT_40237 [Aspergillus niger
ATCC 1015](An07g00760; Ict) mito: 12, cyto: 6, extr: 6, pero: 2
MRHASTSATKKAGPLAGITVVSLEQAIAAPFCTRQLADLGARVIKVERPGVGDFARNYDTRVNGLASHFV

WTNRSKESLALDLKKPSDHSVLMRLLGRADVLVQNLAPGASARLGLSYDDLKAAHPSLIVCNISGYGPDG

PYRDKKAYDLLIQSEAGMLSVTGTGKEPAKVGISIADISAGSTAYSNILAALYQRERDPSKRGCNIDISM

LESMVEWMGFPMYYTTENAPGPTPAGASHAATYPYGPFETGDGTVMLGIQNEREWAKFCDIVLGQPSLAT

NERFVNNSTRSQNRDELKKIICDVESSLSAEQVIARLDAAAIANASVEDMQGVWNHPQLKARQRWIDVKT

PAGSVPALLPPGMTMGDEDTYGARMDAVPDVGEHNKAILAELGLDEGTEK (SEQ ID NO: 27).

M   R   H   A   S   T   S   A   T   K   K   A   G   P   L   A   G   I   T   V                           F1
     1  ATGCGCCATGCTTCTACTAGCGCCACGAAAAAGGCTGGCCCCCTCGCCGGCATCACTGTC                                              60
        ----:----|----:----|----:----|----:----|----:----|----:----|

V   S   L   E   Q   A   I   A   A   P   F   C   T   R   Q   L   A   D   L   G                           F1
    61  GTCAGTCTGGAACAAGCCATAGCCGCTCCCTTCTGTACCCGCCAACTAGCCGACCTAGGA                                              120
        ----:----|----:----|----:----|----:----|----:----|----:----|

A   R   V   I   K   V   E   R   P   G   V   G   D   F   A   R   N   Y   D   T                           F1
   121  GCCCGAGTCATCAAAGTCGAACGACCTGGCGTCGGAGACTTTGCTCGCAATTATGACACC                                              180
        ----:----|----:----|----:----|----:----|----:----|----:----|

R   V   N   G   L   A   S   H   F   V   W   T   N   R   S   K   E   S   L   A                           F1
   181  CGCGTTAACGGCCTAGCCTCCCACTTCGTCTGGACCAACCGGTCTAAAGAGAGTCTCGCC                                              240
        ----:----|----:----|----:----|----:----|----:----|----:----|

L   D   L   K   K   P   S   D   H   S   V   L   M   R   L   L   G   R   A   D                           F1
   241  TTGGACCTCAAAAAGCCGTCCGATCACAGCGTGCTCATGCGCCTGCTCGGCCGCGCCGAT                                              300
        ----:----|----:----|----:----|----:----|----:----|----:----|

V   L   V   Q   N   L   A   P   G   A   S   A   R   L   G   L   S   Y   D   D                           F1
   301  GTCCTCGTCCAGAACCTCGCTCCCGGCGCCAGTGCTCGACTGGGTTTATCCTACGATGAT                                              360
        ----:----|----:----|----:----|----:----|----:----|----:----|

L   K   A   A   H   P   S   L   I   V   C   N   I   S   G   Y   G   P   D   G                           F1
   361  CTCAAAGCGGCTCATCCATCCTTGATTGTGTGCAACATCTCCGGGTATGGTCCTGACGGA                                              420
        ----:----|----:----|----:----|----:----|----:----|----:----|

P   Y   R   D   K   K   A   Y   D   L   L   I   Q   S   E   A   G   M   L   S                           F1
   421  CCGTACCGCGATAAGAAGGCCTACGATCTGTTGATCCAGAGCGAGGCTGGCATGCTCTCC                                              480
        ----:----|----:----|----:----|----:----|----:----|----:----|

V   T   G   T   G   K   E   P   A   K   V   G   I   S   I   A   D   I   S   A                           F1
```

```
                                                                             -continued
    481 GTCACGGGGACGGGAAAAGAGCCCGCCAAGGTGGGCATCTCCATCGCTGATATTTCCGCT                     540
        ----:----|----:----|----:----|----:----|----:----|----:----|
          G  S  T  A  Y  S  N  I  L  A  A  L  Y  Q  R  E  R  D  P  S                   F1
    541 GGTAGCTATGCCTACTCCAATATCCTGGCGGCGTTGTATCAGCGGGAGAGGGATCCCTCG                     600
        ----:----|----:----|----:----|----:----|----:----|----:----|

K  R  G  C  N  I  D  I  S  M  L  E  S  M  V  E  W  M  G  F                   F1
    601 AAGCGGGGGTGTAACATTGATATCTCCATGTTGGAGAGCATGGTTGAGTGGATGGGCTTC                     660
        ----:----|----:----|----:----|----:----|----:----|----:----|

P  M  Y  Y  T  Y  E  N  A  P  G  P  T  P  A  G  A  S  H  A                   F1
    661 CCTATGTATTATACTTATGAGAATGCCCCGGGCCCGACACCAGCGGGTGCTTCGCATGCG                     720
        ----:----|----:----|----:----|----:----|----:----|----:----|

A  I  Y  P  Y  G  P  F  E  T  G  D  G  T  V  M  L  G  I  Q                   F1
    721 GCTATCTATCCTTATGGCCCGTTTGAGACGGGAGATGGAACGGTGATGTTGGGGATCCAG                     780
        ----:----|----:----|----:----|----:----|----:----|----:----|

N  E  R  E  W  A  K  F  C  D  I  V  L  G  Q  P  S  L  A  T                   F1
    781 AATGAGCGTGAGTGGGCTAAGTTCTGTGACATCGTCTTGGGTCAACCCAGTCTTGCTACG                     840
        ----:----|----:----|----:----|----:----|----:----|----:----|

N  E  R  F  V  N  N  S  L  R  S  Q  N  R  D  E  L  K  K  I                   F1
    841 AATGAGCGGTTTGTGAATAACTCGCTGCGCTCGCAGAACCGTGATGAGTTGAAGAAGATA                     900
        ----:----|----:----|----:----|----:----|----:----|----:----|

I  C  D  V  F  S  S  L  S  A  E  Q  V  I  A  R  L  D  A  A                   F1
    901 ATCTGTGACGTCTTCTCGTCGCTTTCGGCGGAGCAGGTGATTGCTCGACTGGATGCAGCG                     960
        ----:----|----:----|----:----|----:----|----:----|----:----|

A  I  A  N  A  S  V  N  D  M  Q  G  V  W  N  H  P  Q  L  K                   F1
    961 GCGATTGCTAATGCCAGCGTCAATGATATGCAAGGCGTCTGGAACCACCCACAGCTCAAG                     1020
        ----:----|----:----|----:----|----:----|----:----|----:----|

A  R  Q  R  W  T  D  V  K  T  P  A  G  S  V  P  A  L  L  P                   F1
   1021 GCTCGGCAGCGATGGACAGATGTTAAGACGCCCGCAGGAAGTGTGCCGGCTCTGCTACCT                     1080
        ----:----|----:----|----:----|----:----|----:----|----:----|

P  G  M  T  M  G  D  E  D  T  Y  G  A  R  M  D  A  V  P  D                   F1
   1081 CCTGGAATGACCATGGGGGATGAGGATACTTATGGGGCGCGCATGGACGCTGTCCCTGAT                     1140
        ----:----|----:----|----:----|----:----|----:----|----:----|

V  G  E  H  N  K  A  I  L  A  E  L  G  L  D  E  G  T  E  K                   F1
   1141 GTGGGTGAGCATAACAAGGCTATTCTGGCCGAGTTGGGGCTCGACGAGGGTACGGAGAAA                     1200
        ----:----|----:----|----:----|----:----|----:----|----:----|

*                                                                            F1
   1201 TAG                                                                             1203
        ---

>gb|AAJN01000170.1|: c168650-165409 Aspergillus terreus NIH2624 cont1.170, whole genome
shotgun sequence (ATEG_06299: lct)
TCCTCTAACGGGGTGGTCCGAGCGAGGAGAATCATCTTCGACGCAACCTGTGCGCAAGTGATCCAGATCT

TCTGTCCAGTTACTGAATACGCGTCCTGGGACGCATTCTTCCTTGCAAGCGTCTTGAGCTTCAGAGTCTC

GAGTCCAGTGTTGGGTTCAGTCACGCCGAAGCATGTCCGCCACGTGCCGTTGATGATCTTGGGGATTGTC

TCCTCCCGTTGCTCTTTCGTTCCAAACTTGGCGAGCGGTTGGGTGGCATACACGTTCGCGTGGATGGACT

GGGCGCCAGCAATGCCGGCCCCTGATTGCGTGATAGTCTGCATCATCATGGTGGCTTCGGAGATGCCTGT

ATAGACGGTTAGGATGTACATATTGTGTAGGCTTGGCCATATCCGAGAAGAGCTCACCTAGTCCTGCACC

TCCGAGCTCCTCTGGAAGAGCAATTCCGAGCCATCCGTCCTTCGCTAGCGCTGCATGGAATTCCTTAGGG

TCTTGCTCGGTCTGGTCGTGCTCCTGCCAGTATGTGTTGGGGAATTTGGAACAAATCGCCGAAATTGCCT

CGCGAACGGTCAACTGCTCCTCAGTGAAGCCGGTCAGCTCCATGAGTGGTCGCTTTGTCGTGGTGGAAAA

CTGTGATGCGCGAGACTTTGATACGGCGAGCCATGTTGGGCCGGATGTGGGTGCAACACGCCGGCGAACA

TGGGCCACTGCCGGACTCAGCCGCAGATATAGATTCCGCTTGGTATATGCAGGGGACATGTGGAGCAATT

GGATTTTCTGGGATGTGCTGACGAACGCAACCAGAATAGAGGCAGATATGCGTCACTTATATCGTACGAT

TGTAGCGGTGGGGAGCTCTTGTTGCATATAGCCGTCCATATACCCGTCGAGTAACCGTGCAGCACCGAGG

TCCATCTGATGTCCAGCTCTGCCGTCCTATGTCACCGATAAATACTCTGCACGCCGTTGCATTTTGCAAC
```

-continued

CATTCTCACAATAAACAGCAATGTCGCTCTCAAGACCCCTAGCGCGAGCGTGGGCCCAGACGCTGGCTCC

CAGCACTCGCAGACACACCTCCACCCAAGCCGGCAAGACCGGGCCCCTCACTGGGATTACAGTCGTCAGT

CTCGAACAAGCTATCGCTGCACCGTTCTGTACGCGGCAGTTGGCAGATCTGGGCGCTCGAGTCATCAAAG

TTGAACGTCCTGGTGTTGGCGATTTCGCGCGCAACTATGATACCCGGGTCAATGGGCTAGCATCTCATTT

CGTCTGGACAAACCGTTCCAAGGAGAGCCTCGCATTGGATGTCAAGAAGCCTCGCGATCACCAGGTATTG

ATGCGCCTTTTGAGCAAGGCCGATGTACTGGTGCAGAACTTGGCTCCCGGAGCGAGCGCTCGGTTGGGCC

TGTCGCACGAGGATCTCAAAGCTACCAACCCATCACTCATCGTGTGCAATATCTCCGGCTATGGTCCTGA

TGGCCCCTATCGCGATAAGAAGGCCTATGATCTTTTGATCCAGAGTGAGGCGGGTATGCTTTCCGTGACA

GGAACGGGGAAGGAACCCGCCAAAGTTGGCATCTCCATCGCCGATATCTCCGCCGGATGCTATGCGTATT

CGAACATCCTTGCCGCGCTGATCCAACGAGACAAGGATCCCAAACGACGCGGTTGCAATATCGATATCTC

CATGCTGGAGAGTATGGTGGAATGGATGGGATTTCCGATGTACTACACCTACGCCAACGCCCCTGGTCCA

ACACCCACAGGGGCATCCCATGCAGCGATCTACCCGTATGGGCCTTTCGAGACGGGAGATGGATCAGTGA

TGCTCGGGATTCAGAACGAAAGAGAGTGGACCAACTTCTGCGACAAGGTCCTTGGGAAACCTGAGCTTGC

AACGGACTCGCGGTTCGCCAACAATTCCTTGCGCTCACAGAATCGCGAAGAGCTGAAAATCATCATCTGC

GAGGTGTTTTCTTCCCTCACAGCCGATCAAGTGATTGCTCGCCTGGATGGAGCTTCAATTGCCAATGCTA

GTGTCAACGACATGCAGGGTGTTTGGAAACACCCTCAACTCAAAGCTCGGGGTCGCTGGACGGAGATCGA

GACGCCAGCTGGTACGGTCCCTGCTCTCTTCCCGCCAGGCATGGATGCGTCAGCGAATTTTGCTGCCCGT

ATGGATGCTGTTCCCGCTGTTGGGAACACAATGAGTCGATTCTGGCTGAGCTGGGTATGAAGGAGTCAA

AATAGGACATAAATGGTGACCTTATGTCGGTTCAGGTGATATGGGTTATAGAGATCATCTCTCGCTATTT

CTGAACTTAGACCTTATAAAACAAGTATGCTTGATCATTAGATTATTGCATTAAGATAGTATCCCTATGC

TTGCCACAGGCTGAAACAGCCAGCAAGAACGCTCGAAACAGATTATAGACTAGGCTCACATTAAGCCCAC

GAGAAGGACAAGGGGGGATAAATAGCAGCAGTATCAAGAGACCATAAACGAGCCTGTACCTCTGTCCCAT

GGTCACAAGATAGGACACTTGTTGACGGCATCTGCAGCGCAGTCGAGTCCAGCCTTACACTGGTATGGAG

AGATACCCTGTTGGCCGCATGTGGTGAACTGGAAGCCAGGCATCATTAGTCCTATTCATCTAACAGACAC

AGACAGGCATACCTTTGGAAGACAGTCGTAGGCTTTGTTGGTGACCACGACGCAGAATAGCCAGCGGACG

GCCTTCACTCACTCCGAACTGGATGGCTAGCCACCCCATGGCACGGAGGAAATTCTCCCAGGGCCCCGTC

ATGGTGACGAGGTCAGTATTGAGGTTGATTTCAACACCATCCGGACCGAAGACATTTGCTGATAACACAC

TTAGTGACATTCAGGTGGAAGGGGTGGGATCCAATACCTCCATTCTCGTGTGCCAATATCGTCCCTGGT

AGACTCCGCCGGTGTACAGATCAAGCTGACTCCTGTTGTCCGGGATTTCAGTGTATGACACCTCCCCATA

TGGAGTAGAGACCGCATTGATGGGTTCGTTGACGACTGGGCCTCTCTTGACAGGTGAAGCTGTCACCAAG

-continued

GAGCAAGAAAGGGCGAGAACCCCGGTGACCCAGGAGTAGAAGGGAGCCATCCTGCCAGTATGAGGGTCAA

TTTTTTCAATATAAAATGCTGAAGGGCGCAAGGTACCTGCTATAACAGGGTCTGATGGCTTCAGTGATGG

TTGTTGCGGATGATGTTCAGCA (SEQ ID NO: 28).

>gi|114191143|gb|EAU32843.1| hypothetical protein ATEG 06299 [Aspergillus terreus
NIH2624] (ATEG_06299: Ict) mito: 25
MSLSRPLARAWAQTLAPSTRRHTSTQAGKTGPLTGITVVSLEQATAAPFCTRQLADLGARVIKVERPGVG

DFARNYDTRVNGLASHFVWTNRSKESLALDVKKPRDHQVLMRLLSKADVLVQNLAPGASARLGLSHEDLK

ATNPSLIVCNISGYGPDGPYRDKKAYDLLIQSEAGMLSVTGTGKEPAKVGISIADISAGCYAYSNILAAL

IQRDKDPKRRGCNIDISMLESMVEWMGFPMYYTYANAPGPTPTGASHAAIYPYGPFETGDGSVMLGIQNE

REWTNFCDKVLGKPELATDSRFANNSTRSQNREELKIIICEVFSSLTADQVIARLDGASIANASVNDMQG

VWKHPQLKARGRWTEIETPAGTVPALFPPGMDASANFAARMDAVPAVGEHNESILAELGMKESK
(SEQ ID NO: 49).

```
        M   S   L   S   R   P   L   A   R   A   W   A   Q   T   L   A   P   S   T   R              F1
    1 ATGTCGCTCTCAAGACCCCTAGCGCGAGCGTGGGCCCAGACGCTGGCTCCCAGCACTCGC                                     60
      ----:----|----:----|----:----|----:----|----:----|----:----|

R   H   T   S   T   Q   A   G   K   T   G   P   L   T   G   I   T   V   V   S              F1
   61 AGACACACCTCCACCCAAGCCGGCAAGACCGGGCCCCTCACTGGGATTACAGTCGTCAGT                                    120
      ----:----|----:----|----:----|----:----|----:----|----:----|

L   E   Q   A   I   A   A   P   F   C   T   R   Q   L   A   D   L   G   A   R              F1
  121 CTCGAACAAGCTATCGCTGCACCGTTCTGTACGCGGCAGTTGGCAGATCTGGGCGCTCGA                                    180
      ----:----|----:----|----:----|----:----|----:----|----:----|

V   I   K   V   E   R   P   G   V   G   D   F   A   R   N   Y   D   T   R   V              F1
  181 GTCATCAAAGTTGAACGTCCTGGTGTTGGCGATTTCGCGCGCAACTATGATACCCGGGTC                                    240
      ----:----|----:----|----:----|----:----|----:----|----:----|

N   G   L   A   S   H   F   V   W   T   N   R   S   K   E   S   L   A   L   D              F1
  241 AATGGGCTAGCATCTCATTTCGTCTGGACAAACCGTTCCAAGGAGAGCCTCGCATTGGAT                                    300
      ----:----|----:----|----:----|----:----|----:----|----:----|

V   K   K   P   R   D   H   Q   V   L   M   R   L   L   S   K   A   D   V   L              F1
  301 GTCAAGAAGCCTCGCGATCACCAGGTATTGATGCGCCTTTTGAGCAAGGCCGATGTACTG                                    360
      ----:----|----:----|----:----|----:----|----:----|----:----|

V   Q   N   L   A   P   G   A   S   A   R   L   G   L   S   H   E   D   L   K              F1
  361 GTGCAGAACTTGGCTCCCGGAGCGAGCGCTCGGTTGGGCCTGTCGCACGAGGATCTCAAA                                    420
      ----:----|----:----|----:----|----:----|----:----|----:----|

A   T   N   P   S   L   I   V   C   N   I   S   G   Y   G   P   D   G   P   Y              F1
  421 GCTACCAACCCATCACTCATCGTGTGCAATATCTCCGGCTATGGTCCTGATGGCCCCTAT                                    480
      ----:----|----:----|----:----|----:----|----:----|----:----|

R   D   K   K   A   Y   D   L   L   I   Q   S   E   A   G   M   L   S   V   T              F1
  481 CGCGATAAGAAGGCCTATGATCTTTTGATCCAGAGTGAGGCGGGTATGCTTTCCGTGACA                                    540
      ----:----|----:----|----:----|----:----|----:----|----:----|

G   T   G   K   E   P   A   K   V   G   I   S   I   A   D   I   S   A   G   C              F1
  541 GGAACGGGGAAGGAACCCGCCAAAGTTGGCATCTCCATCGCCGATATCTCCGCCGGATGC                                    600
      ----:----|----:----|----:----|----:----|----:----|----:----|

Y   A   Y   S   N   I   L   A   A   L   I   Q   R   D   K   D   P   K   R   R              F1
  601 TATGCGTATTCGAACATCCTTGCCGCGCTGATCCAACGAGACAAGGATCCCAAACGACGC                                    660
      ----:----|----:----|----:----|----:----|----:----|----:----|

G   C   N   I   D   I   S   M   L   E   S   M   V   E   W   M   G   F   P   M              F1
  661 GGTTGCAATATCGATATCTCCATGCTGGAGAGTATGGTGGAATGGATGGGATTTCCGATG                                    720
      ----:----|----:----|----:----|----:----|----:----|----:----|

Y   Y   T   Y   A   N   A   P   G   P   T   P   T   G   A   S   H   A   A   I              F1
  721 TACTACACCTACGCCAACGCCCCTGGTCCAACACCCACAGGGGCATCCCATGCAGCGATC                                    780
      ----:----|----:----|----:----|----:----|----:----|----:----|

Y   P   Y   G   P   F   E   T   G   D   G   S   V   M   L   G   I   Q   N   E              F1
  781 TACCCGTATGGGCCTTTCGAGACGGGAGATGGATCAGTGATGCTCGGATTCAGAACGAA                                     840
      ----:----|----:----|----:----|----:----|----:----|----:----|

R   E   W   T   N   F   C   D   K   V   L   G   K   P   E   L   A   T   D   S              F1
  841 AGAGAGTGGACCAACTTCTGCGACAAGGTCCTTGGGAAACCTGAGCTTGCAACGGACTCG                                    900
      ----:----|----:----|----:----|----:----|----:----|----:----|
```

```
          R  F  A  N  N  S  L  R  S  Q  N  R  E  E  L  K  I  I  I  C              F1
  901 CGGTTCGCCAACAATTCCTTGCGCTCACAGAATCGCGAAGAGCTGAAAATCATCATCTGC                 960
      ----:----|----:----|----:----|----:----|----:----|----:----|

E  V  F  S  S  L  T  A  D  Q  V  I  A  R  L  D  G  A  S  I           F1
  961 GAGGTGTTTTCTTCCCTCACAGCCGATCAAGTGATTGCTCGCCTGGATGGAGCTTCAATT                 1020
      ----:----|----:----|----:----|----:----|----:----|----:----|

A  N  A  S  V  N  D  M  Q  G  V  W  K  H  P  Q  L  K  A  R           F1
 1021 GCCAATGCTAGTGTCAACGACATGCAGGGTGTTTGGAAACACCCTCAACTCAAAGCTCGG                 1080
      ----:----|----:----|----:----|----:----|----:----|----:----|

G  R  W  T  E  I  E  T  P  A  G  T  V  P  A  L  F  P  P  G           F1
 1081 GGTCGCTGGACGGAGATCGAGACGCCAGCTGGTACGGTCCCTGCTCTCTTCCCGCCAGGC                 1140
      ----:----|----:----|----:----|----:----|----:----|----:----|

M  D  A  S  A  N  F  A  A  R  M  D  A  V  P  A  V  G  E  H           F1
 1141 ATGGATGCGTCAGCGAATTTTGCTGCCCGTATGGATGCTGTTCCCGCTGTTGGGGAACAC                 1200
      ----:----|----:----|----:----|----:----|----:----|----:----|

N  E  S  I  L  A  E  L  G  M  K  E  S  K  *                          F1
 1201 AATGAGTCGATTCTGGCTGAGCTGGGTATGAAGGAGTCAAAATAG                                1245
      ----:----|----:----|----:----|----:----|----:
``` citramalyl-CoA lyase
>gb|ACJE01000004.1|: c2178751-2175602 Aspergillus niger ATCC 1015, whole genome shotgun
sequence citramalyl-CoA lyase (Ccl) An01g08610
TGCGGGTAGTGGGATCGGAGGACTCGAAGACCCAAGTAGAGTCGCCGGAGGAAGTGTTGACTTCGTTCCA

CCAACGGAGACCGACCAGTCGGCGACCGGCGATGTTTTTGAGGTAGTAGAAATCGGCGGAAAGGATGAGG

AGGGTGATGATGAAGACGAGGACGCTGGTTGCAGTGGTTAGCTTGGTTGTTTGCTCGGATCTAGATAGGG

TAGCTCTGGGAGGTTCCGGGTTTGGAGATTAAGGGAGCTAGAATCTTGAAGTTGAGTTTGAAAGGTGTTT

TACGCACAAGTTCTTGATAAAGAGCACGCCGAAGAGGTACATCAGTAGGGCGCCGATGCGAAAGCCCAGG

AAGAACAGGAGAGTAATCGGATGGGCACTGAGGCGCCAGTTCAGTTCGCCCTGCTGCGGCTGGAGCGGTT

GTTGTTCCATGATGACAAAAAAGGGGCAGGATCAAGTCAAGAAATATCCTCTGGAAACAGTCCAATGCAC

ATGAGATAGACGGCAGTCAAGCAGCCTCCTGACGAGTCCAGATCATGCGAGGCGGGATTGCGTTGATGCT

GCGTGTCTCCAGCCAGGGGCGGTGGGGCGCGGCAGAATGTGGAGCGGCGGACGGTTACTTGACACTCTTT

CATCTTATTTCTCCGACTCCCATCTGTTTCATGCGCGATCGGCACTCGGGCTCTTTCATATTGCTCAGCT

TGGTGTACAAGAAAGACAAAGGCAGTGGTTGTCACAGGTGAATAATGCAAGTGCCAATGGAACGAACTAA

ATACGGGCCAGTCGCGACACCTGCCGGATGAGGTCATCGGCCGGTTCCTGACTGGAGAAGCCTTTATGCG

CAAACCGAGGATCTCTTAAAGTTGCGGGTCAATCCGCAACCGCTGCAGCAGCTTCATCCGATAATCTCCA

TTCTTTCAACCCAACAGGAGACATTGCAGTTCAGTGTGATCCCAAACTCATTACCATCGCCTCAACTGAA

CACTATCTCTCTCATCGACCATGGCCGCCAGAAACACACTCCGTCGCGCCCTTCTCTACAGTACGTCACT

GCCCCCTTCTCTTCCCAACCCATAGCTCTCCCCGCATTTCCGCACTCATCCCACACCCCAACATGCTATC

*CGACTATACCAATTACCCCCTAACTAACCCCCAATCCCAGTCCCGGGCTCCTCCCAACGCTTCATCGATA*

AATCCCGCACACTAACCGCCGACTGCGTGGCCTACGATCTCGAAGACAGCGTAACTCCGCACAAGAAAGC

GGAAGCTCGGTCCCTGGTGCGGAGAGCACTCGACGAGCCCGCACCGCAGGGAATCCGCGAACGAGCCGTA

CGAATCAACTCCGTGGACAGCGGCCTCGCCCTAGGCGATCTCACCGAAGTG*GTGAGTACCATTATCATCC*

*CTCACTTTTCTCCTCCATTCAACTCACTAAATCCGGTAATAGCTCAAATCCCCCAATCTCACAACAATCG*

*TGATCCCCAAAGTCAACACCCCCTCGGACCTCACTTTCGTGAACGATGTCATCACGCACACTCTCTCCCA*

*ACAACAACAGG*ATCCTTCCACCCCGAGACCTCCAATCTCCCTCCTCGCTCTAGTCGAATCCGCCAAATCC

-continued

```
CTCACAAACCTCACTCAAATCTGCGCCTCCACGCCCCTCCTGCAGGGCCTCATTTTCGCGGCCGAAGACT

TCGCACTCGACCTCAGCATCACCCGTACCCCGTCATTAACTGAGTTCCTCTTCGCAAGATCTATGATTGC

TACGGCTGCTCGCGCTGCGAACCTCCCCTCTACTATTGATTTGGTCTGTACAGCGTACAAATCTACCAAG

GGGGACGGGTCCCCGCCTGCGGTGCTGGAGGAGGAATGTCGCGATGGGAGACGGCTAGGGTTCAATGGGA

AGCAGTGTATTCATCCGTCGCAGGTGGAGACGGCGCAGGCGATCTTTGGACCGGATCCGGAAGAAGTTAA

GTGGGCTGTGAGGGTGTGTGTGGCGGATGAGAAGGCTGCGAGAGCGGGACGGGGTGCGTGGACGCTTGAT

GGGAAAATGATTGATGTGCCGGTGGCGGAGAAGGCCAGGGCGGTGGTTAGGAAGGCGGAGGCGTGTGGAT

TTGATGTTGGGAAGTTGAGGGAGGAGTGGGGGCATCAGGAACCGGAGTGAGCATGCTTGTACTAGGTGGT

GTTTGTGTCTTGAGTGAGAGGAGTTATATATACAAAAATTCAGTCAAGCCAGTTGACAAATTAGGAGTAA

CTATTTATGGTACTTGTTGGATGAGGGGAAGGTAGAACCGAAATGAGATCAAGAAAAGATTTGAGTAGAT

AGTCTATCGATCACCTCTTATACTCCGGGACTATCACTTCCCTACAAGAATTCACATAAAACCCAGTAGT

CTCCCAAAGCGTATGCTAGGCTGAGTTGGAGGTAATGTTGAATTCGGGAGATCGAGCATCAAGAAAGGTT

TTCTTGAGTGTTTGAAGAAGATTTGCTGTTTATTATTGCTTTGACTCCAGGTCTTCGCGCTTCAACAGCT

GGATCTTGCCCATGGTCAAGATGGGCTGGTCCGCATCCGCCTTGCTGTTTGCATCATCTTCCAGACTCTT

GGCTAGTGATTTATCGTAGCTGGTGGGGTCAATCCCCAGGATTCCACCAACATATCCACCCCGCTCGCCG

GGGACACTGAACTCGCGGAACAGGTACTTCCATTCATTTAACCATGCCTTGACGGCCTTGCCGATCTTGT

CCTTGCCATTCTTGGAATGATGGCCCGTGCCTGTGATCGCGTAGACTACGCGCCGGCCTTCGCGGGCATG

CTTGAGCAGGATCTTTTCCAGGTATTCAATGGCCTCCTCGGGATGCAAGCCATGCAGGTCAACGTACAGT

TCCTCCGCTGCATCATCCAGACCAGCGTCAAGGATGTTTGTTACGTTCTTCGTAAAGTTGCCGGGCTG

CTTCCCGATGACACTTGCGCATGGCTTCGTTTTCAGCCTGACCCCGCAGAGACAAAGCCTTTGCGGCTCT

TGCGTCATTGCGGTTCCACGCTTGAGCAGCACTAACCAGACAATTAGCTTCAAGCCTTCGGACTTCAAAA

GTGTCAATTTACCTTTGAAGGAATTTGTTCCTCACCGTACCATGGCGGATAGCCTCCGTCCGGTATTTGA
(SEQ ID NO: 29).
```

>gi|350638357|gb|EHA26713.1| citrate lyase [*Aspergillus niger* ATCC 1015] (An01g08610: Ccl) mito: 26

```
MAARNTLRRALLYIPGSSQRFIDKSRTLTADCVAYDLEDSVTPHKKAEARSLVRRALDEPAPQGIRERAV

RINSVDSGLALGDLTEVLKSPNLTTIVIPKVNTPSDLTFVNDVITHTLSQQQQDPSTPRPPISLLALVES

AKSLINLIQICASTPLLQGLIFAAEDFALDLSITRIPSLIEFLFARSMIATAARAANLPSTIDLVCIAYK

STKGDGSPPAVLEEECRDGRRLGFNGKQCIHPSQVETAQAIFGPDPEEVKWAVRVCVADEKAARAGRGAW

TLDGKMIDVPVAEKARAVVRKAEACGFDVGKLREEWGHQEPE        (SEQ ID NO: 30).
```

```
        M   A   A   R   N   T   L   R   R   A   L   L   Y   I                          F1
    1 ATGGCCGCCAGAAACACACTCCGTCGCGCCCTTCTCTACA*GTACGTCACTGCCCCCTTCT*                     60

----:----|----:----|----:----|----:----|----:----|----:----|

61 *CTTCCCAACCCATAGCTCTCCCCGCATTTCCGCACTCATCCCACACCCCAACATGCTATC*                    120

----:----|----:----|----:----|----:----|----:----|----:----|

P   G   S   S   Q   R            F1
  121 *CGACTATACCAATTACCCCCTAACTAACCCCCAATCCCAG*TCCCGGGCTCCTCCCAACGC                    180

----:----|----:----|----:----|----:----|----:----|----:----|

F   I   D   K   S   R   T   L   T   A   D   C   V   A   Y   D   L   E   D   S   F1
        S   S   I   N   P   A   H   *   P   P   T   A   W   P   T   I   S   K   T   A   F2
```

```
                   H  R  *  I  P  H  T  N  R  R  L  R  G  L  R  S  R  R  Q  R          F3
     181 TTCATCGATAAATCCCGCACACTAACCGCCGACTGCGTGGCCTACGATCTCGAAGACAGC                    240
         ----:----|----:----|----:----|----:----|----:----|----:----|

V  T  P  H  K  K  A  E  A  R  S  L  V  R  R  A  L  D  E  P               F1
              *  L  R  T  R  K  R  K  L  G  P  W  C  G  E  H  S  T  S  P               F2
                 N  S  A  Q  E  S  G  S  S  V  P  G  A  E  S  T  R  R  A  R            F3
     241 GTAACTCCGCACAAGAAAGCGGAAGCTCGGTCCCTGGTGCGGAGAGCACTCGACGAGCCC                    300
         ----:----|----:----|----:----|----:----|----:----|----:----|

A  P  Q  G  I  R  E  R  A  V  R  I  N  S  V  D  S  G  L  A               F1
              H  R  R  E  S  A  N  E  P  Y  E  S  T  P  W  T  A  A  S  P               F2
                 T  A  G  N  P  R  T  S  R  T  N  Q  L  R  G  Q  R  P  R  P            F3
     301 GCACCGCAGGGAATCCGCGAACGAGCCGTACGAATCAACTCCGTGGACAGCGGCCTCGCC                    360
         ----:----|----:----|----:----|----:----|----:----|----:----|

L  G  D  L  T  E  V                                                       F1
     361 CTAGGCGATCTCACCGAAGTG*GTGAGTACCATTATCATCCCTCACTTTTCTCCTCCATTC*                   420

----:----|----:----|----:----|----:----|----:----|----:----|

L  K  S  P  N  L  T  T  I  V  I  P  K              F2
     421 *AACTCACTAAATCCGGTAATAG*CTCAAATCCCCCAATCTCACAACAATCGTGATCCCCAA                   480

----:----|----:----|----:----|----:----|----:----|----:----|

V  N  T  P  S  D  L  T  F  V  N  D  V  I  T  H  T  L  S  Q               F2
     481 AGTCAACACCCCCTCGGACCTCACTTTCGTGAACGATGTCATCACGCACACTCTCTCCCA                    540
         ----:----|----:----|----:----|----:----|----:----|----:----|

Q  Q  Q  D  P  S  T  P  R  P  P  I  S  L  L  A  L  V  E  S               F2
     541 ACAACAACAGGATCCTTCCACCCCGAGACCTCCAATCTCCCTCCTCGCTCTAGTCGAATC                    600
         ----:----|----:----|----:----|----:----|----:----|----:----|

A  K  S  L  T  N  L  T  Q  I  C  A  S  T  P  L  L  Q  G  L               F2
     601 CGCCAAATCCCTCACAAACCTCACTCAAATCTGCGCCTCCACGCCCCTCCTGCAGGGCCT                    660
         ----:----|----:----|----:----|----:----|----:----|----:----|

I  F  A  A  E  D  F  A  L  D  L  S  I  T  R  T  P  S  L  T               F2
     661 CATTTTCGCGGCCGAAGACTTCGCACTCGACCTCAGCATCACCCGTACCCCGTCATTAAC                    720
         ----:----|----:----|----:----|----:----|----:----|----:----|

E  F  L  F  A  R  S  M  I  A  T  A  A  R  A  A  N  L  P  S               F2
     721 TGAGTTCCTCTTCGCAAGATCTATGATTGCTACGGCTGCTCGCGCTGCGAACCTCCCCTC                    780
         ----:----|----:----|----:----|----:----|----:----|----:----|

T  I  D  L  V  C  T  A  Y  K  S  T  K  G  D  G  S  P  P  A               F2
     781 TACTATTGATTTGGTCTGTACAGCGTACAAATCTACCAAGGGGGACGGGTCCCCGCCTGC                    840
         ----:----|----:----|----:----|----:----|----:----|----:----|

V  L  E  E  E  C  R  D  G  R  R  L  G  F  N  G  K  Q  C  I               F2
     841 GGTGCTGGAGGAGGAATGTCGCGATGGGAGACGGCTAGGGTTCAATGGGAAGCAGTGTAT                    900
         ----:----|----:----|----:----|----:----|----:----|----:----|

H  P  S  Q  V  E  T  A  Q  A  I  F  G  P  D  P  E  E  V  K               F2
     901 TCATCCGTCGCAGGTGGAGACGGCGCAGGCGATCTTTGGACCGGATCCGGAAGAAGTTAA                    960
         ----:----|----:----|----:----|----:----|----:----|----:----|

W  A  V  R  V  C  V  A  D  E  K  A  A  R  A  G  R  G  A  W               F2
     961 GTGGGCTGTGAGGGTGTGTGTGGCGGATGAGAAGGCTGCGAGAGCGGGACGGGGTGCGTG                    1020
         ----:----|----:----|----:----|----:----|----:----|----:----|

T  L  D  G  K  M  I  D  V  P  V  A  E  K  A  R  A  V  V  R               F2
    1021 GACGCTTGATGGGAAAATGATTGATGTGCCGGTGGCGGAGAAGGCCAGGGCGGTGGTTAG                    1080
         ----:----|----:----|----:----|----:----|----:----|----:----|

K  A  E  A  C  G  F  D  V  G  K  L  R  E  E  W  G  H  Q  E               F2
    1081 GAAGGCGGAGGCGTGTGGATTTGATGTTGGGAAGTTGAGGGAGGAGTGGGGGCATCAGGA                    1140
         ----:----|----:----|----:----|----:----|----:----|----:----|

P  E  *                                                                   F2
    1141 ACCGGAGTGA                                                                      1150
         ----:----|
```

>gb|AAJN01000091.1|: c71368-68661 Aspergillus terreus NIH2624 cont1.91, whole genome shotgun sequence (ATEG_03186: Cc1)
GGAGGGGTTCCTGTTCCATGATGCGAGGACGGAAAGTTAGACAACGCGAAAAGCAGAGAGAGGTCCAGGC

GGATGGGAGCAATCACGCTCGCGCTTCTTGGGAGAATCAACACGGGGAAAGTAAGAGCTGGATGCGATGA

TGCGGCCGATGAAGCTGCGTGGCTCCATCCCGGGCGGTAACGTCTGGCAGAATGGCCCGCCTACTCAGTC

-continued

ACCTATTTACAGTTCTACTCTCTACTCCGGAGTATAGCCAAGTCACCATTCCACCGTATGGACAAAGATG

GACCTCAATATGTGTTATCTGAGCTGCGACGGGTAAATGCTTGCAGTTATTGTCTAGTAGTGATGGGTGG

GCCAGCCAATATACCCGACCCATCTGCATCATAGCACTGATGGCCGGAGAAGCCTTTATGCAGCAAACCG

AGGGCATCCTTAAAACCCGCCAGCTTCCATAACTTGCCCTCTTGCATTCTCCCCGTCTTCACTTCCACCA

GCACACTGGAAAGTCATTAGTCTGCGCAGAACAGAGCATCAATTTACTTCATTATATCGAAACGGACGGC

CCCTCCTACAATGGCATCCAGAAACACCCTGCGCCGCGCCCTCCTATACA*GTACGTCAACATACGTTCTT*

*CCCCGCATCTGCCTCCTATCCGACCTACATGATAGAGTCGCGGCGCCTACACAATGACAACCCCTGACAC*

*AAACTCCTAGTTCCGGGATCGTCGCAGCGATTTATCGACAAGTCCCGCACCCTGACCGCCGATTGTGTCG*

*CCTACGATCTGGAGGACAGCGTGACTCCGCACAAGAAAGCGGAAGCCCGCTCTTTGGTGCGGAGAGCGCT*

*GGACCAGCCCGCGCCGACTGGCATTCTCGAGCGCGCAGTTCGTATCAACTCCGTCGACAGTGGCCTGGCG*

*CTCGCTGATCTGACAGAAGTC**GTACGTCTACTATCCTCTTCTGAGAAACCAGGTAGATAATATAAGAACA*

*TTGGACTGACAGAAACGCAGC**TCCAATCCCCCAATCTGTCCACAATCGTGATTCCCAAAGTCAACTCCGC*

*ATCAGACCTCACCTTCGTCACGGACGTCATCACGCACACGCTCTCACAGCTGCCTCCATCGCAAACCACG*

*TCGCGCCCGCCCATCTCGCTCTTGGCTCTTGTCGAATCGGCCAAATCCCTCACCAATCTGAGCCAGATTT*

*GTGCTGCATCACCCCTTCTCCAGGGCCTGATTTTCGCTGCAGAGGATTTCGCCCTGGATCTTAGTCTCAC*

*GCGGACGCCGGCCCTGACGGAATTCCTTTTCGCTCGGTCTGCCATTGCCACCGCCGCTCGCGCTGCCAAC*

*CTCCCCTCAACCATCGACTTGGTCTGCACGACATACAAGTCCGACAAAGCTGACGGGTCTCCGCCGGCGG*

*TGCTGCAGCAAGAATGCCGCGACGGCAAAAATCTGGGATTCAACGGCAAGCAGTGCATTCACCCGTCTCA*

*GGTATCGACTGTGCAGCAGATCTTTGGTCCGGAGCTGGAGGAAGTGCAATGGGCGGTGCGGGTAACTATT*

*GCGGATGACAAGGCCGCTAAAGCGGGTCGCGGTGCTTGGACTCTAGATGGGAAGATGATCGACATCCCAG*

*TCGCTGAGAAAGCTCGTGCGATTGTGAAAAAGGCTGACGCCTGTGGCTTCAACGTCCAGGAGCTGCGTGA*

*GAAATGGCAGCACCAAGAGCCCGAGTAG*ATCTTCAGGGACGGCGATGTGCCAAGGAACCAAAGTAAAGCT

GTAAGTTCTAGAACATTGAATATATACATTCCACAGTTAGCCTGCATATCGTTGAGAGTATGCACAGTAA

GAGAGAATACAATACAACAAGTACGAATATAGTGTGCTGAATGAGAAGACAAACAGATTCTAGAGGGGAA

AACTTCAGGGATGCTACGCTCATTGAAGGAAAAGGGATCTCGTGAAAATCGTAAAGTGGATGGGGGTCCT

GGTAGCAAGAAGTTGATGTCATTCGGGCTTTGACTCCAAGTCTTCACGCTTTAGCAGCTGGATCTTCCCC

GCTGCTAACAGGGGTTGATTACCGGCTTCATTGTCTCCGCCGTCTTCTAGAGCTTTGGCCAGGCTCTTGT

CATAGCTGGTGGGATCGATTCCCAATATGCCGCCAACGTAACCACCGCGTTCACCGGGCACACTAAACTC

GCGGAATAAATATTTCCACTCGTTCAGCCATGCTTTCACTGCCTTGCCTATCTTGTCTTTGCCATTCTTA

GAATGGTGGCCAGTACCGGTGATGGCATAGACGACACGTCGCCCCTCACGGGCGTGCTTCAGGAGGATCT

TCTCCAAGTACTCAATGGCTTCTTCGGGGTGCAACCCATGCAGATCAACATAGAGTTCTTCTGATGAATC

CTCTAATCCAGCATTGAGAAGATGTTTATTGCGCTCTTCGTAGAGTTGGCGCGCTGCCTCTCTATGACAT

TTGCGCATGGCTTCATTCTCTGCCTGGCCCCGGAGAGATAGTGCCTTTGCAGCTCTAGCATCATTCCGAT

-continued

```
TCCATGCTTGCGCAGCGCTTCAGGAAGACTGTCAGCTCTGTGTTAGTCAGTATAAGATGGCGCGCATACC

TCTGAAGAAATTTGTTTCTCACGGTGCCATGACGGATGGCCTCCGTACGGTACTTGATGTATTGTTGGTT

TGCACGCTGCCCGGTCTCGAGCCAGGGAATGTTCTGGGGAGGCGGGAT (SEQ ID NO: 31).
```

>gi|114194760|gb|EAU36460.1| conserved hypothetical protein [*Aspergillus terreus* NIH2624] (ATEG_03186: Cc1) mito: 25, cyto: 1.5

```
MASRNTLRRALLYIPGSSQRFIDKSRTLTADCVAYDLEDSVTPHKKAEARSLVRRALDQPAPTGILERAV

RINSVDSGLALADLTEVLQSPNLSTIVIPKVNSASDLTFVTDVITHTLSQLPPSQTTSRPPISLLALVES

AKSLINTSQICAASPLLQGLIFAAEDFALDLSLTRIPALTEFLFARSAIATAARAANLPSTIDLVCITYK

SDKADGSPPAVLQQECRDGKELGENGKQCIHPSQVSTVQQIFGPELEEVQWAVRVTIADDKAAKAGRGAW

TLDGKMIDIPVAEKARAIVKKADACGFNVQELREKWQHQEPE (SEQ ID NO: 32).
```

```
         M   A   S   R   N   T   L   R   R   A   L   L   Y   I                F1
   1 ATGGCATCCAGAAACACCCTGCGCCGCGCCCTCCTATACAGTACGTCAACATACGTTCTT              60
     ----:----|----:----|----:----|----:----|----:----|----:----|

61 CCCCGCATCTGCCTCCTATCCGACCTACATGATAGAGTCGCGGCGCCTACACAATGACAA            120
     ----:----|----:----|----:----|----:----|----:----|----:----|

P   G   S   S   Q   R   F   I   D   K   S   R   T    F2
 121 CCCCTGACACAAACTCCTAGTTCCGGGATCGTCGCAGCGATTTATCGACAAGTCCCGCAC            180
     ----:----|----:----|----:----|----:----|----:----|----:----|

L   T   A   D   C   V   A   Y   D   L   E   D   S   V   T   P   H   K   K   A    F2
 181 CCTGACCGCCGATTGTGTCGCCTACGATCTGGAGGACAGCGTGACTCCGCACAAGAAAGC            240
     ----:----|----:----|----:----|----:----|----:----|----:----|

E   A   R   S   L   V   R   R   A   L   D   Q   P   A   P   T   G   I   L   E    F2
 241 GGAAGCCCGCTCTTTGGTGCGGAGAGCGCTGGACCAGCCCGCGCCGACTGGCATTCTCGA            300
     ----:----|----:----|----:----|----:----|----:----|----:----|

R   A   V   R   I   N   S   V   D   S   G   L   A   L   A   D   L   T   E   V    F2
 301 GCGCGCAGTTCGTATCAACTCCGTCGACAGTGGCCTGGCGCTCGCTGATCTGACAGAAGT            360
     ----:----|----:----|----:----|----:----|----:----|----:----|

F2
 361 CGTACGTCTACTATCCTCTTCTGAGAAACCAGGTAGATAATATAAGAACATTGGACTGAC            420
     ----:----|----:----|----:----|----:----|----:----|----:----|

L   Q   S   P   N   L   S   T   I   V   I   P   K   V   N   S   A    F2
 421 AGAAACGCAGCTCCAATCCCCCAATCTGTCCACAATCGTGATTCCCAAAGTCAACTCCGC            480
     ----:----|----:----|----:----|----:----|----:----|----:----|

S   D   L   T   F   V   T   D   V   I   T   H   T   L   S   Q   L   P   P   S    F2
 481 ATCAGACCTCACCTTCGTCACGGACGTCATCACGCACACGCTCTCACAGCTGCCTCCATC            540
     ----:----|----:----|----:----|----:----|----:----|----:----|

Q   T   T   S   R   P   P   I   S   L   L   A   L   V   E   S   A   K   S   L    F2
 541 GCAAACCACGTCGCGCCCGCCCATCTCGCTCTTGGCTCTTGTCGAATCGGCCAAATCCCT            600
     ----:----|----:----|----:----|----:----|----:----|----:----|

T   N   L   S   Q   I   C   A   A   S   P   L   L   Q   G   L   I   F   A   A    F2
 601 CACCAATCTGAGCCAGATTTGTGCTGCATCACCCCTTCTCCAGGGCCTGATTTTCGCTGC            660
     ----:----|----:----|----:----|----:----|----:----|----:----|

E   D   F   A   L   D   L   S   L   T   R   T   P   A   L   T   E   F   L   F    F2
 661 AGAGGATTTCGCCCTGGATCTTAGTCTCACGCGGACGCCGGCCCTGACGGAATTCCTTTT            720
     ----:----|----:----|----:----|----:----|----:----|----:----|

A   R   S   A   I   A   T   A   A   R   A   A   N   L   P   S   T   I   D   L    F2
 721 CGCTCGGTCTGCCATTGCCACCGCCGCTCGCGCTGCCAACCTCCCCTCAACCATCGACTT            780
     ----:----|----:----|----:----|----:----|----:----|----:----|

V   C   T   T   Y   K   S   D   K   A   D   G   S   P   P   A   V   L   Q   Q    F2
 781 GGTCTGCACGACATACAAGTCCGACAAAGCTGACGGGTCTCCGCCGGCGGTGCTGCAGCA            840
     ----:----|----:----|----:----|----:----|----:----|----:----|

E   C   R   D   G   K   N   L   G   F   N   G   K   Q   C   I   H   P   S   Q    F2
 841 AGAATGCCGCGACGGCAAAAATCTGGGATTCAACGGCAAGCAGTGCATTCACCCGTCTCA            900
```

-continued

```
             V  S  T  V  Q  Q  I  F  G  P  E  L  E  E  V  Q  W  A  V  R                F2
     901 GGTATCGACTGTGCAGCAGATCTTTGGTCCGGAGCTGGAGGAAGTGCAATGGGCCGGTGCG                    960

V  T  I  A  D  D  K  A  A  K  A  G  R  G  A  W  T  L  D  G                 F2
     961 GGTAACTATTGCGGATGACAAGGCCGCTAAAGCGGGTCGCGGTGCTTGGACTCTAGATGG                     1020

K  M  I  D  I  P  V  A  E  K  A  R  A  I  V  K  K  A  D  A                 F2
    1021 GAAGATGATCGACATCCCAGTCGCTGAGAAAGCTCGTGCGATTGTGAAAAAGGCTGACGC                     1080

C  G  F  N  V  Q  E  L  R  E  K  W  Q  H  Q  E  P  E  *                    F2
    1081 CTGTGGCTTCAACGTCCAGGAGCTGCGTGAGAAATGGCAGCACCAAGAGCCCGAGTAG                       1138
```

Trans-aconitate 2-methyltransferase
>gb|ACJE01000013.1|: 1755738-1758598 *Aspergillus niger* ATCC 1015, whole genome shotgun
sequence (An16g06510: Trans-aconitate 2-methyltransferase)
CAGGGCTATCGAGTACGGTACGACTTGTACACGATGATATGGTATGCAAGCGAATACATCACTGGCAGTA

ATCTAAATATCGAATACTTAGCCCCCATAGAAGAACCGCAGCTGCGTTTAGTCTATTGGAAGACTCTAGT

GTCTGGTGAAAGGACGATTAAGTCCGAATAACTGCCCAGTAACATAGAGAGTGGCCTATATTGGTCAAAC

GTCTGAAGAGGGGAATTCTATGCTTGCGGCCTCATTTGATGTCAAGCTTAGCACGGATAAAAGCGTGTTT

AGTATGTGTATGCTGTTTCTTCCCCTGGTCTAATTTGAAGTGCTATGTTCTTCATTCTATCTCTTCATAC

TCTTAGAAGGTTCTAATTATCCTATCGTCCTCTCATCTCTAGATCTGGACTATATAGGCGTCAATTGAGT

GACAGTGGCATGGTGATTATTGGCAGTATAAAGATATTTGTCTATATTATAAGCGACTGATGGCAACGCG

CCCACCTGACTATTTCGGTAGACTTGAATTAGCAGGATACTGTATCTTACGGTTGATATTTAATTAGTGC

GAGAATTAGCGATATGACAACGCGGAATAGCTATCCCTGGCTGAAGTTCTGCCCTTCAATCTTCGAGGTG

TAATCCAGCGGCAACATCCGTTGAACACGTGCGGGGTGGAAGTCCCCGACGAACTTGTCGACGCGACGAA

ATCTGTATGTTTTCAGAGTAACCTCACGTATCCGCGTCTTCCGGGTTGACAGCATAAGATGATATCAGTG

TAATATAATAAGTAAGCAAGTAAGCAGGGCTGACGAAGATTGTTCCTATCCCGTGATACTTTAACAGAGA

AGCCAATCATGTTTCCGCCGAAACCGGCACTTTCGAGGTACCACCACCACTATAACATCATCCCACTTAT

ATACCTCACAACAATATAAATACTGAAGTTCCTATACATCGTCAACACTAACAACACATCCATCTACAAC

CACCAGCTGTTAAACATCAAATGTTCCGTCCTCGCCTACCACTCTCTCCTCACCGCATCTCCCATCTTCT

CTCCCACCCCGCCAAAATGTCCGACTGGAGCGCAACCCAATACCTCAAATTCGCCGACGAGCGCGCCATC

CCAACCCAAGATCTCCTAGCATACATCCCCCTGCAATCTCCCTCCCACATCGTTGATCTTGGCTGCGGCC

CCGGAAACTCCACCGCCATGCTTTCCGCCCGCTACCCATCCTGCCCGAGCATCTCCGGCATCGACTCCTC

CCCAAACATGATCGCCCGCGCCAAAGAATCATCTAACAACAATACGACCTTCGCCGTGGCGGACGTGGAA

ACCTACTCTCCCCCAACCAACCACCCCGTAGATCTCTTCTTCTCCAACGCTGTCCTGCACTGGCTTCCCC

GTTCTACTCGTCTCCCTACTATCCGCAGACTCCTACTAACTCTTCCCCCGGGCGGGGTCTTCGCCTTCCA

GGTCCCGGATACCTTGAACGAGCCATCGCATACATCTATGCGGGAGGTCGCGAGGACGGGGCCCTGGCG

GAACATCTACGGAGTACGTTGGTAGAGAGGGATGAGTTGGAGTCACCCGGGGAGATTTATGATGCGTTGG

TGGACTGTTGTGAGAGTTTGAGGATTTGGGAGTCGGTGTATTATCATTCCCTTGGGAGTTGGGGGGAGAT

TGTGGAGTGGGTGAAGGGGACGGGGTTGAGGCCGTATTTGGATGGGTTGAGGGGAGAGGAGGAACGGGGG

-continued

```
GAGTTTTTGAAGGTGTATGAGGAGAAATTGAGGGAGAAGTATGAGAAAAGGGCTGATGGGAGGGTATTGT

TGAGGTATCCCAGGTTGTTTGCTGTTGCTGTTCGGAAGTGATTTTCTTCTCTTGTTTATTTACGAGATTG

GGTTTGGAGGTGCAGTGTATAGGTAGAGGACAGAATGGAGGATGCTCTGATCATGTCATCCAAGCTTCCA

GTGTATATGGCAGGCATGCATGCTGGTATAATCCTAAGTTTATAGCTCGCATATGGAATATATCGTCAGG

TCCATGTAAGCCGTCACGCAGGTACATAGCTTGGCCTAGCAAGCTTATAGCTGGACTGAACCACCTCAAT

TGATCCTGTGATACAAATTAAAATGCATGACTCAAACAGTTTCACCAGAAATCTCGCCAGCGCTCGATCA

TTCCCCGGACGCCATCAAGTTAGAATGCTGAGATTGAAAGCGGGACACGAACAAGGAACGCAGTTACACA

GAACCACATTACCACCTGGTTCAATGCCAATTACATAATTGCAAAATGGTACAGATCGTCAATCCATGCA

TAATAGCATTGTCTATACCCCAGCTTCATCGAAATAGATCACTTACTGCAGACTCCCTCCTTCACAGCAT

ACCCGACGGCCATCCCGATCAAGGGGACCGAATGCCCCGGAATCATCAACCCACATTCCACGCCCCTTA

TATTACCACAAATCTCCACTACAATCCCCGCGTTCAAGGAACGCCCCTTAGCTAACCCAAACAAGGGCGC

GTCAACAAACCGACCGCCATACGGCGTAACATGCCTCATTCCGCCCTGAAGAACTGATTCCCCACCAATA

CCTTACTGCGGAAATCATTTACCCGGAGTATCCAGGCACAATCCAATCAAGCCATGCATGCACCCACGCA

GGTGTACACAGGCATGCCTTGAAGATGCCAACGCGTTCGCTTATTTCCTCCTTCTCTCCCCTCCCTTGAA

GAATCGAATATAAAATCCAGCTTGATATCCACGACAGATTCTCTTTTTCATCCATCAGCAACAATCACAG

CAGCAGTCTAGCAGCCAATACTTTCTCTTCCACGACAACAATCAAAATGCAATTCACCACC
(SEQ ID NO: 33).
```

>gi|350633811|gb|EHA22176.1| hypothetical protein ASPNIDRAFT_40903 [*Aspergillus niger*
ATCC 1015] An16g06510: trans-aconitate 2-methyltransferase) cyto: 13, cyto_nucl:
12.333, cyto_mito: 9.999, nucl: 8.5, mito: 5.5
MSDWSATQYLKFADERAIPTQDLLAHIPLQSPSHIVDLGCGPGNSTAMLSARYPSCPSISGIDSSPNMIA

RAKESSNNNTTFAVADVETYSPPTNHPVDLFFSNAVLHWLPRSTRLPTIRRLLLTLPPGGVFAFQVPDTL

NEPSHTSMREVARTGPWAEHLRSTLVERDELESPGEIYDALVDCCESTRIWESVYTHSLGSWGEIVEWVK

GTGLRPYLDGLRGEEERGEFLKVYEEKLREKYEKRADGRVLLRYPRLFAVAVRK (SEQ ID NO: 126).

```
          M   S   D   W   S   A   T   Q   Y   L   K   F   A   D   E   R   A   I   P   T                    F1
     1 ATGTCCGACTGGAGCGCAACCCAATACCTCAAATTCGCCGACGAGCGCGCCATCCCAACC                                            60
       ----:----|----:----|----:----|----:----|----:----|----:----|

Q   D   L   L   A   H   I   P   L   Q   S   P   S   H   I   V   D   L   G   C                    F1
    61 CAAGATCTCCIAGCACACATCCCCCIGCAATCTCCCICCCACATCGTTGATCTIGGCTGC                                            120
       ----:----|----:----|----:----|----:----|----:----|----:----|

G   P   G   N   S   T   A   M   L   S   A   R   Y   P   S   C   P   S   I   S                    F1
   121 GGCCCCGGAAACTCCACCGCCATGCTTTCCGCCCGCTACCCATCCTGCCCGAGCATCTCC                                            180
       ----:----|----:----|----:----|----:----|----:----|----:----|

G   I   D   S   S   P   N   M   I   A   R   A   K   E   S   S   N   N   N   T                    F1
   181 GGCATCGACTCCTCCCCCAAACATGATCGCCCGCGCCAAAGAATCATCTAACAACAATACG                                            240
       ----:----|----:----|----:----|----:----|----:----|----:----|

T   F   A   V   A   D   V   E   T   Y   S   P   P   T   N   H   P   V   D   L                    F1
   241 ACCTTCGCCGTGGCGGACGTGGAAACCTACTCTCCCCCAACCAACCACCCCGTAGATCTC                                            300
       ----:----|----:----|----:----|----:----|----:----|----:----|

F   F   S   N   A   V   L   H   W   L   P   R   S   T   R   L   P   T   I   R                    F1
   301 TTCTTCTCCAACGCTGTCCTGCACTGGCTTCCCCGTTCTACTCGTCTCCCTACTATCCGC                                            360
       ----:----|----:----|----:----|----:----|----:----|----:----|

R   L   L   L   T   L   P   P   G   G   V   F   A   F   Q   V   P   D   T   L                    F1
   361 AGACTCCTACTAACTCTTCCCCCGGGCGGGGTCTTCGCCTTCCAGGTCCCGGATACCTTG                                            420
       ----:----|----:----|----:----|----:----|----:----|----:----|

N   E   P   S   H   T   S   M   R   E   V   A   R   T   G   P   W   A   E   H                    F1
   421 AACGAGCCATCGCATACATCTATGCGGGAGGTCGCGAGGACGGGGCCCTGGGCGGAACAT                                            480
       ----:----|----:----|----:----|----:----|----:----|----:----|

L   R   S   T   L   V   E   R   D   E   L   E   S   P   G   E   I   Y   D   A                    F1
   481 CTACGGAGTACGTTGGTAGAGAGGGATGAGTTGGAGTCACCCGGGGAGATTTATGATGCG                                            540
       ----:----|----:----|----:----|----:----|----:----|----:----|
```

```
              L   V   D   C   C   E   S   T   R   I   W   E   S   V   Y   T   H   S   L   G                F1
         541  TTGGTGGACTGTTGTGAGAGTTTGAGGATTTGGGAGTCGGTGTATTATCATTCCCTTGGG                                    600
              ----:----|----:----|----:----|----:----|----:----|----:----|

S   W   G   E   I   V   E   W   V   K   G   T   G   L   R   P   Y   L   D   G                F1
         601  AGTTGGGGGGAGATTGTGGAGTGGGTGAAGGGGACGGGGTTGAGGCCGTATTTGGATGGG                                    660
              ----:----|----:----|----:----|----:----|----:----|----:----|

L   R   G   E   E   E   R   G   E   F   L   K   V   Y   E   E   K   L   R   E                F1
         661  TTGAGGGGAGAGGAGGAACGGGGGGAGTTTTTGAAGGTGTATGAGGAGAAATTGAGGGAG                                    720
              ----:----|----:----|----:----|----:----|----:----|----:----|

K   Y   E   K   R   A   D   G   R   V   L   L   R   Y   P   R   L   F   A   V                F1
         721  AAGTATGAGAAAAGGGCTGATGGGAGGGTATTGTTGAGGTATCCCAGGTTGTTTGCTGTT                                    780
              ----:----|----:----|----:----|----:----|----:----|----:----|

A   V   R   K   *                                                                             F1
         781  GCTGTTCGGAAGTGA                                                                                 795
              ----:----|----:
```

>gb|AAJN01000116.1|: 171440-174275 *Aspergillus terreus* NIH2624 cont1.116, whole genome shotgun sequence (ATEG_04223: trans-aconitate 2-methyltransferase)
GCGGTAACATGACCGAAGCAGCGCCATCGTCGCCTTCCAGAAGAAGGGCATGGACGTGTCGACGGGCACA

GTTGGACCTCTTCTACCTGGTATTAGATGTGCGCTGACAGTCCAGGGGACGGCGGAGGACACGCCCGAGG

GCGGACCGGGCGAGCTGTGGATCAGCGGGCCGAATGTTGCGTCCGGGTATGTCTGCGTCGCTGATAGTGA

CGCGGTCAAAGCCAAGTCGTTTCCGCTGCCTGGATGGTACAACACGGGGGATGTGTGCACAATTGACGAG

AATGCGTTCCTCGCTGTTGTCAGCCGCACGAAGGAGCTTATCAAGTACGAAAGGTTCCAGGCGAGTCCGG

TTGAGCTGGATGCGTATCTTAATCGAAATCCGCTGGTGTGGCGTGTGGGAAGTGAGCGAGTTGCCCTGGA

ATGCAACTATGAAGATTTTGAGGACTGAGCTCAAGAAGCGTGTTACAGGTATTTGCTCGTTGGGGAGGGC

TCGACCAAAGGCTAGGTTGTAGGCTGTAGCACTACATCTAGAGTATCTCAGTGTCGAGACTTAGCACATA

CAATATCGTACGTATTATTCCTGAACCTGTTCGATCAAATCCTATGGTCTATGAAAGCGAAGGGAATCCT

CCGAATATCGGCAGTTTCACAACTAGTCGCCTCCGTGAGCAAGAGGTACGAGATACCAACTAACCCGTAG

AACGGATTGGTAGAACATGACAAGTCATATGTTGGAAATTATGGCATTAATTAGCATAATCAACTCTTCT

CTTCGCATAGAATGAGTCAAGACTCCGATGTTCGGTGAAGTAACAAATAGATCACTCCCGCGATCACAAC

ACCAACCCCTTGGGTCATCCGGTATTTATTCAGATGCAATTCGTGTCATCAAACCAACACATCCTCAGCT

ACATCTCAATCACTGAAATGCTAACTCCTCCTCAACCACTTTCTGCCCGGCTGATCTGGAAGAACCTCTC

CTTCAAGACCCTCACAACTCCCCGCACAATGTCCACAGCAAACCCCACAACAACCAAAGACTGGAGCGCA

TCGCAATACCTCAAATTCGCAGATGAAAGAACGCTGCCCGCCCGCGAACTGCTCGCTCGCGTCCCGCTCG

AAGCCCCCAAGACAATCGTCGACCTGGGCTGCGGACCGGGAAACTCGACCGCCGTGCTCGCAGCCCGGTA

CCCGGGCGCCCACATCGTGGGGCTGGACTCCTCGCCCGACATGATCCAAAAGGCCAAGTCGACCCTGCCG

GAGATCGACTTCCGCGTCGCAGACTTGCGGTCGTACACACCGTCGTCGCCGACGGATCTGTTCTTTTCCA

ACGCGGTGCTGCAGTGGCTCCGCAGAGATGAGCGCATCGAGGTTGTCAAGCGCTTGCTGCGGACGCAGTC

GCCAGGCGGCGTGTTTGCGTTCCAGGTGCCGGATAACTTGATGGAGCCGTCGCATGTTCTCATGAGAGAT

GTTGCGGCGCGCGGGCCGTGGGCGGAGACGCTGACGCATGTCCACAGAGATGGTATCCAGTCGCCGCAGG

AGATCTACGACGAGCTTATACCGCTGTGTGCGACGGTGAGCATATTCCACACGCACTACTACCATTCTCT

GGAGAATCATGAGGCGATTGTCGAGTGGCTCAAGGGGACTGGACTTCGGCCGTATGTTGACCCTCTGGGT

-continued

CCGGCGGAGAAGAAGGCGTTCATCGCGGAGTACTTGAAGCGCTTAGAGGGTGCGTATCCCCGGTCTGTAG

ATGGCCGTGTTTTGCTACGGTTTCCGAGATTGTTTGTTGTAGCTGTTAGGAAGTAGCATTCCATGTCCAT

CTATCATGTTATTGTTCATAGTCCTGCGAACACCCCATATCCGATGCAATCTGATCCGGTTCCCGAAGTC

GTCCCGTGGCGGAAAAGATGCGTAAGAACAAGACGTTCAGCATCAGATGCCGCCTAAGCGGTAGTGGTAG

TGACGGACTAACGTAATATCCTGCTGAGACCATGGAATTGGCCTACGACAAAGAAAGAGGTCTTCCTGCT

ATGTCGGTTGTTTGTATAAGCCTCCTCTTTGTAACATATATTGTCTCATCTGGAACAGGCATGCCAGACT

TCGTGCATTACACGAAAATTGTATGAGCTGTCTAGAATAAAACCAGTTCCAGTCCAAGCCGCGCAAAGTA

CATGTCCCACGGCAATGAAGTGCCAGAGGCCCAGAACGTGCTTAGCAAACGCTTGGCCCTGGTAAAATTT

CCCATTCCAAAACCCTGCATATTGTTCATGCGATCTTGTACAAAGCTTCGTTGATTTGGATCCTCTGTCT

CACACCCCGCGCTGAATATCGGCCATAAAATAAGGATATTTGCTGGTGATAGCGGCCGAATGTGTGCTAC

GGCATCAAGGAEGTTCTCAATATCTGCCAAAACTTTTGTGCTGTTTTTAGGCAGCATCTGAACTCGGCGG

TGAAGATGCAACAACGCTGAATAGACAAAGGCGTGGTGGGTCTCTTGTAGCTCAGTGGCGAGTTCACCTC

GCGAGCTTCTCACATTGTCGGATACAGTGCGGCCAACGAGAGAGTAAAGCTCTGTTTCCAGGATCTGAGC

GTCCCGATCGATATCTCGAGGTACTTCATTCCCGAGACTCGCGTCTGTATGGCGTTGCAAAATCAAGTCT

GATAGACGAGCGAGAATCGGTATCAGATCCAATGAATAACCACAAATATCGTCCACATCCCTCGTGTCAG

TGCCGACCATACTCAGTGGCATGGTCTGAGCGTCGTGGACACAGCCTGCTTGCAGCCCTGACAAACCAGC

CAACACATCCATTGTCATGAACCATTTTGCCAGACA (SEQ ID NO: 35).

>gi|115391793|ref|XP_001213401.1| trans-aconitate 2-methyltransferase [*Aspergillus terreus* NIH2624] (ATEG_04223: trans-aconitate 2-methyltransferase) mito: 13.5, cyto_mito: 10.833, cyto: 7, pero: 5, cyto_nucl: 4.833
MSTAKPTTTKDWSASQYLKFADERTLPARELLARVPLEAPKTIVDLGCGPGNSTAVLAARYPGAHIVGLD

SSPDMIQKAKSTLPEIDERVADLRSYTPSSPIDLFFSNAVLQWLRRDERIEINKRLLRIQSPGGVFAFQV

PDNLMEPSHVLMRDVAARGPWAETLTHVHRDGIQSPQEIYDELIPLCATVSIFHTHYTHSLENHEAIVEW

LKGTGLRPYVDPLGPAEKKAFIAEYLKRLEGAYPRSVDGRVLLRFPRLFVVAVRK (SEQ ID NO: 36).

```
        M   S   T   A   K   P   T   T   T   K   D   W   S   A   S   Q   Y   L   K   F                F1
      1 ATGTCCACAGCAAAGCCCACAACAACCAAAGACTGGAGCGCATCGCAATACCTCAAATTC                                   60
        ----:----|----:----|----:----|----:----|----:----|----:----|

A   D   E   R   T   L   P   A   R   E   L   L   A   R   V   P   L   E   A   P                F1
     61 GCAGATGAAAGAACGCTGCCCGCCCGCGAACTGCTCGCTCGCGTCCCGCTCGAAGCCCCC                                    120
        ----:----|----:----|----:----|----:----|----:----|----:----|

K   T   I   V   D   L   G   C   G   P   G   N   S   T   A   V   L   A   A   R                F1
    121 AAGACAATCGTCGACCTGGGCTGCGGACCGGGAAACTCGACCGCCGTGCTCGCAGCCCGG                                    180
        ----:----|----:----|----:----|----:----|----:----|----:----|

Y   P   G   A   H   I   V   G   L   D   S   S   P   D   M   I   Q   K   A   K                F1
    181 TACCCGGGCGCCCACATCGTGGGGCTGGACTCCTCGCCCGACATGATCCAAAAGGCCAAG                                    240
        ----:----|----:----|----:----|----:----|----:----|----:----|

S   T   L   P   E   I   D   F   R   V   A   D   L   R   S   Y   T   P   S   S                F1
    241 TCGACCCTGCCGGAGATCGACTTCCGCGTCGCAGACTTGCGGTCGTACACACCGTCGTCG                                    300
        ----:----|----:----|----:----|----:----|----:----|----:----|

P   T   D   L   F   F   S   N   A   V   L   Q   W   L   R   R   D   E   R   I                F1
    301 CCGACGGATCTGTTCTTTTCCAACGCGGTGCTGCAGTGGCTCCGCAGAGATGAGCGCATC                                    360
        ----:----|----:----|----:----|----:----|----:----|----:----|

E   V   V   K   R   L   L   R   T   Q   S   P   G   G   V   F   A   F   Q   V                F1
    361 GAGGTTGTCAAGCGCTTGCTGCGGACGCAGTCGCCAGGCGGCGTGTTTGCGTTCCAGGTG                                    420
        ----:----|----:----|----:----|----:----|----:----|----:----|

P   D   N   L   M   E   P   S   H   V   L   M   R   D   V   A   A   R   G   P                F1
    421 CCGGATAACTTGATGGAGCCGTCGCATGTTCTCATGAGAGATGTTGCGGCGCGCGGGCCG                                    480
        ----:----|----:----|----:----|----:----|----:----|----:----|

W   A   E   T   L   T   H   V   H   R   D   G   I   Q   S   P   Q   E   I   Y                F1
    481 TGGGCGGAGACGCTGACGCATGTCCACAGAGATGGTATCCAGTCGCCGCAGGAGATCTAC                                    540
```

-continued

```
              D  E  L  I  P  L  C  A  T  V  S  I  F  H  T  H  Y  Y  H  S                  F1
     541 GACGAGCTTATACCGCTGTGTGCGACGGTGAGCATATTCCACACGCACTACTACCATTCT                       600

L  E  N  H  E  A  I  V  E  W  L  K  G  T  G  L  R  P  Y  V                  F1
     601 CTGGAGAATCATGAGGCGATTGTCGAGTGGCTCAAGGGGACTGGACTTCGGCCGTATGTT                       660

D  P  L  G  P  A  E  K  K  A  F  I  A  E  Y  L  K  R  L  E                  F1
     661 GACCCTCTGGGTCCGGCGGAGAAGAAGGCGTTCATCGCGGAGTACTTGAAGCGCTTAGAG                       720

G  A  Y  P  R  S  V  D  G  R  V  L  L  R  F  P  R  L  F  V                  F1
     721 GGTGCGTATCCCCGGTCTGTAGATGGCCGTGTTTTGCTACGGTTTCCGAGATTGTTTGTT                       780

V  A  V  R  K  *                                                            F1
     781 GTAGCTGTTAGGAAGTAG                                                                 798
```

```
5-flank An07g09220/pyrE
1        10        20        30        40        50
|         |         |         |         |         |
CGTCCACTTGACTGTACTCAAGTCAACGACCAGAAAGGCGTCAAAAATTC

AAGTAATTCAGCAAGAAAGACGTCTACTTGATATCAACATATCAACTTAA

GAAAGAAGAAAGAGAGTGTGTGTGCGTGTGTGCAGGAAACAAGCCGACGA

AACTGATTGTGTCTGATCGGAAGGCCAGGCAGGCAATAATGTTAGATGTC

AAGCCCAAACAGGCAAAAATCAACGCGAAGGGGCTCATACGTCTTCCGTT

TACACTATCTATTCAACAAGTTTACCATACCATTGAAAGTCATTAAATAT

AGGGGAAAGTTGAACAACGATGCTGCGGGTGCCGGACTATGGGACATGGG

AATGAACCAGAAGGTGGGGTACCCATGGATTATGTCCACCTGCTGCGGTC

TTCAAGCGAGGTGCAGGGGCTGCTGGTACGAGGCAGTTTGTACTGGCAG

TCTAATCTTGGCAAGAATCATCGGACAGCCAGCCGCGTCTGACACCTATC

AAGTGGTTTGGGCAGTTAAGTTTACGGAGAATCTGATTATCCTAACGCAA

ACCCTTTGCGATCGATACATTTATTACATGATTATATTAGGGGCATATAT

ACTCTATGTCCATATATTTTGGATGATACTCTCTGTAATGCCGATTCTTA

GCGGGGTCTACCTACTACCATAGACACAAGGATTAGCTTATTTCATTACT

TAGTCGAGATGCGAGGGAATCCCGGAGTTTCTCGACAGAGGAATTCTCGA

CTCTTCTAGATCGCCTCGACAAGAACAAGAATGTAGGCCTACGGGAAATT

TATGGCGCATCTGAGCATTGCTATAGGACTGTTATTTGACATGAAGCTGC

ATTCCGCTACCACGCGGCTCCGGTAAGGGTAATATAAGTGCTGCTTATTT

TCGGACCCTGATAGCCTTCAAGCATCACTGGTCTAGTGTACCCAGCGCCG

GCGACGATGAGTGGATATATTCGCTGTGGCAGTTAAAACGGTGCAGTATA

GCCTACCTAAAATGTACAAGGCATCAACACCTAGTAGTGCCAAAAAAATC

ACGCTTTTATTTCAAAAGAGTACGCCTATCTTTAGTCTTTCCGCTGTCAC

CGACAACTACTCCGTAGTTCAATAAGAAGTAGAACATCAATTATCAGAAA

CTCTTTCCTGACGGGGTTTCTATCTATTTACTACCGAATAGTACTTTTAA

TATCTTGAAACCTGCTGAAGTCAGTACTACTGTGCCATAGAGAAAACAGG

AAACCCCTCCACGCTCGGCGTCATTTCTCCCAGACCGAGAGAATGCGGCG

GCTAAATGACGGCGCCGAAGCGACCCCATAAAGGCTACTCGGAACATAGC

CTCTGGATCCCGGTCTCGGAAATGCCCAGCGACCCGAGGTACAAAACCCC
```

```
AGCACTTCCGAGACAACGCCATGTTAAGCTCGCCTCTTCACTTCTTCCAC

GATCACTCGAACCACACTGAAGCATTATTTCACTCTCAATTAAAATAACC

AAGCCGCTGCTGGAATTG

TTGTGTGTAGTTAGGCTAGATGACAGTACTAAAATTAGCGGATCTGTTGG

GAATGATAATTGTAGTACAACTTCAACTTCGCTAGAAGGTCCAAAGGAAT

AAACTTACAGGAACAATGATGGGCTTTTTCACAACTGGGGCAAATTGTCT

AGCTTAAACAGCGCTCTTGGTTGCTGTTCAACCGTTCCTGGTATTATCGG

TCACCGGGCCTGCCAGCGAACAGTGTTAATATACCGAATGAGAAGCTTCC

AACAAACAAACGAAGAAGAATTGAAAAGAATGAAAGACTGCTGCAAAGCC

AGGTCTCAGAAGAAGGAAGAAAAGCCCAAGGGAAGGGAGGGGAAAAAAAC

CGACCTTACGTTAAAGCAAGGGGAAGATGAGATAACCTATCGTAAAGAAG

GCCGGACTTCGGAGGTTGCCCTGTGGCACGTGTCCCACTCCCAATCGGTC

AGTTACAGACCCTCAACAGAGCCTAAGGGTTATTTAGTGCACAGAATATG

AGATCCAGGACTATATAGGGACACCAGTTCACTCTGAGATGTTTGAACCA

GGCAGATCGGGCGGTAAGCAGAGAAAGAGGAACTTGGGAGAGGAGGAGAG

AAAGAGAGCTAACACGATACGTCGGTCCGATCCACGGGCCTCCTCCCAGA

CCCCTCATTCCTGCCATTGGCCTAAGGCCTTCGCCCGCCTTGCCCCTCCT

TGGGAAATTGCCTAAAAGAAAATCATAAAAAAAAAAAAAGACCCATCGAT

CGTTGCTGATAACCGTCTTTTCCCCCAAAACAAGTCTCACCACCGAATCT

CACTACTCTGGACTATTTTTGTGTTTAACCAATTGAGGCTCCCAAATTAT

TAGCCTTGTTCCACTGAACCCTGAAATCTTCTATCAACACAAAAGTCGTC

GCAAGGAAGATCTACAACAATGTCCGCCGCTACCATCCCTGCTCCTGCCG

CCGAGCAAGACTACAAGGAGACATTGCTTCCCTTGTTGATGAAGAATAAC

GTCCTGTCCTTTGGCTCCTTTATCCTTAAGTCCGGCCGTGAATCTCCGTA

CTTCTTCACCTCTTCTCTCCTCCACACTGCGCCTTTGCTCCGTGCCACCT

CGGCAGCCTATGCCAGTGTCTTGTCTGCCCCGCCATTCGTAACTGTTGCG

GCGGACGGTACTACCACACCCAACTTCGACATTATCTTTGGCCCGGCTTA

TAAGGGCATTCCGGTGTGCGCTTCCGTTCTGAATGAATTAGCGGTGCGAG

ACTCTCTCTCCGCGTCTGCTAAGGGAACCTGGGACAATGTCAGCTACTCC

TTCAACCGTAAGGAGGCCAAGGACCACGGTGAAGGAGGAAACATTGTCGG

TGCTCCTCTGAAGGGAAAGCGTGTTGTCATTGTCGACGATGTTATCACAG

CTGGAACCGCCATCCGCGAGGCCGTGAGCATCATTCAGAAGGAAGGCGGT

ATTGTTACCGGCATTGTTGTCCTACTTGATCGCGAGGAAAGAGTCAGCGA

CGCTGAGCCTAAGAGCGCTATCGGCGTTGCACAGAGGGATCTTGG
(SEQ ID NO: 37).

3-flank An07g09220/pyrE
1         10        20        30        40        50
|         |         |         |         |         |
ATCTCCGTACTTCTTCACCTCTTCTCTCCTCCACACTGCGCCTTTGCTCC

GTGCCACCTCGGCAGCCTATGCCAGTGTCTTGTCTGCCCCGCCATTCGTA

ACTGTTGCGGCGGACGGTACTACCACACCCAACTTCGACATTATCTTTGG

CCCGGCTTATAAGGGCATTCCGGTGTGCGCTTCCGTTCTGAATGAATTAG

CGGTGCGAGACTCTCTCTCCGCGTCTGCTAAGGGAACCTGGGACAATGTC
```

```
AGCTACTCCTTCAACCGTAAGGAGGCCAAGGACCACGGTGAAGGAGGAAA

CATTGTCGGTGCTCCTCTGAAGGGAAAGCGTGTTGTCATTGTCGACGATG

TTATCACAGCTGGAACCGCCATCCGCGAGGCCGTGAGCATCATTCAGAAG

GAAGGCGGTATTGTTACCGGCATTGTTGTCCTACTTGATCGCGAGGAAAG

AGTCAGCGACGCTGAGCCTAAGAGCGCTATCGGCGTTGCACAGAGGGATC

TTGGTGAAAACATCCCCATTCGCGCAGTGATTGGTCTTCACGACTTGATC

GAAAAGCTGGGTGATAAGATCGGGGAGTCCGAGATCCAGCGCTTGAAGGA

TTACAGGGCTCGCTACGGAGCCGAATAGATCCGGTGCATTAGCATTATAG

GCAAAAAATAGACGACGAAATGATCATATTTTTCTTGTAAATACGCTGAT

TTGGCGCACATTCCTTCCCCGTTGTCGGTGTATCGAAATCGGGTGAAGA

GGCATTTCTTACGTTCTTTTTTGGATTATCTTTTTTATTTATAGATTCAA

TAGTGTCAATTTTTAATTGACATGGCTTATGTAGCATGCCCATGTATGTA

CGACTGCTTTTACGATAAATGACTCAATATAGAACTTGTTACGTGCATCG

TTATATATATCTTGGCGAACGTTTTGCCATTCTGAGCAACAATTTGACTG

GCATATGGGGCAGCTACACTAACATGTGTAGATTTATGAAGACTAGATCT

GTTATTAGTAGAAATTTACAAGAATATATTGAGAATGTACTTAAGTAGCA

CATGTTCCGGTTTCAGTTAAATGCCTACACAAGCATATACAGTTGCTCAC

TATATCAAAATGGATAGACATAGTATATATACATGTCCCTTCAAGAATCT

TTCATATGAGATTCCTGCGGAATATACTTTAAAGGATTGATTGGAATGCA

TCTGTTAGATTTGCCACAGGCCTCGCAATCAAATCATCTACT

AAGCCGCTGCTGGAATTG

GCCTACCT

AAAATGTACAAGGCATCAACACCTAGTAGTGCCAAAAAAATCACGCTTTT

ATTTCAAAAGAGTACGCCTATCTTTAGTCTTTCCGCTGTCACCGACAACT

ACTCCGTAGTTCAATAAGAAGTAGAACATCAATTATCAGAAACTCTTTCC

TGACGGGGTTTCTATCTATTTACTACCGAATAGTACTTTTAATATCTTGA

AACCTGCTGAAGTCAGTACTACTGTGCCATAGAGAAAACAGGAAACCCCT

CCACGCTCGGCGTCATTTCTCCCAGACCGAGAGAATGCGGCGGCTAAATG

ACGGCGCCGAAGCGACCCCATAAAGGCTACTCGGAACATAGCCTCTGGAT

CCCGGTCTCGGAAATGCCCAGCGACCCGAGGTACAAAACCCCAGCACTTC

CGAGACAACGCCATGTTAAGCTCGCCTCTTCACTTCTTCCACGATCACTC

GAACCACACTGAAGCATTATTTCACTCTCAATTAAAATAACC

ACACGGCACAATTATCCATCG

TTGGATAG

GAGGTGAGCTGATCTGCTATCTATTTGTTTTGTGAGTTTGGGGATAGTGC

TGATGAGACTATATGTAGGAACTGGGTCTTTCGCAAAGCTCTTACCTCGC

CGTCGCCTACGAGTTCATCTACACCCCCGGCGACGAAGGCATTTAATGGA

CCAGCTAGTTCGTCTACGGAGACGAGTGAAAATGTGCACACGCGCACATT

GCGCCAAACGGCAGTGACATTGTTCCGGTTCTCCGCGTTGACGTTCAATC

CGCACAAGATCCATTACTCGACACCGTGGGCGAGAGATGTCGAGGGTCAT
```

```
AAGGATATTGTTGTGCATGGACCGTTGAATCTCATTTCGATTTTGCATCT
GTGGCGCGATACGAGGAAGAATGGAAGTGGGGAGGAGGTGGTTCTTCCGG
AGAAGATCTCGTACAGGGCGACGAGTCCGCTGTATGCGGAGGAGGAGTAT
CGGATTGTGTTGGAAGATGGAGAGGATGGGATCGGGAGGGTGCAGATTGT
TGCGCCAGGGGAGGTGGTGGCTATGAAGGCGGAGATTCAGTAGAAATCGT
GTAGTTAGTAGGAGTGGGTTGTAGATATTGTCTGTTTCTAGCTGGGAGGG
ATACATGTATGGGGTGCTACACAAGAGTACTAAATGACATACCCTGAGAT
AGAAATAGTATAGGAGTTATCTACTGTATAGTACTACCCTTTTGAACAAG
TACCGAATCTTCAATTCTATATAACTTATCTGCTCCACTTCATTCTTAAA
GTATGGTTCGGACTTATCTTCGGAGATAACCACTCCACCCCCATCCTTAT
CGCCATCACGGCAGCCTTCCATTCCACTTCAATCCGACACTCAACTCAAC
TTCACATCCACTATTTATCTATCGACCACAACTACCCCACCCTCCACACA
TCTCCCCTGATACTCGGTACATACTAGACCCACTATATACTCCACTGCCC
AACGACACAGACCGAACAAGAACAGACATGGAAAAGAAACGCACCCGCGT
TCAAC (SEQ ID NO: 38).

5-flank An07g00760/pyrE
1         10        20        30        40        50
|         |         |         |         |         |
ACAGGGCAGCGGACTTCATGGACTACGGCAGGCTGCGCCGGACATTGGGA
CGTGTTCATGCGACACTTGATTCATATCGACAGCGGGCAATATGATTCGC
TAATATACCCTTCACGGCCAGTCCTCAGTTTGGCCTAGATTTACAATTCC
GTCCGCACTAAAGAATGCAGACCGAGTATTGACTTGGGCATCAGTTCTGC
TCAGGTCATAGCACAAATGCTTCTGATCGGAGAATTTCGGATGTATCCGA
AACATCTGCTTGCGGCTGCACACCGACATGAAAAAGGCACGTCTCATTCA
TCGGAATATTCCCCGTCTCAAAGTTGGTGACGTGAACGGCACATTAACCC
CACCAATCAGACGCCAGGGAGGCCTGATGCTAGCCCGATGATCGTCAAGC
GAGTTCCCTGGACGATGCCGTCCTCCCCGATGGAACAGCCATTATCCATC
TGCTGGATGGGAATACTAGCCCGTTGAACCGAGCTACTTCAGGAACAGAT
GTTCAAGTGTGACCTTCCCGTCTTTAAGTAGTATAGCTTCACAATTGGGG
GTTAAGGCTGCTTGTGTCCCTTGTAAGTGACCGACATCAGCAATGGCCGT
TATGACGACCCTCCGGTATTTGGTCGCATACGAGGTGCAGTAGTACAGCA
TATTAGACCAAAAGCCTCCAGGGTGCTTGCATTGGGATGAACATCGTCCA
GGATCACCTCCGGCGGTATCCAGCAGGTGTTCAGCCGAATAGCCCCGTGG
CTGTATTTGGCAGGGAGTATCCTTGTCGGTTTGCATATAGGTAGCTGTCT
AGAACTTGTGAGTTCGAGCTGCGCAGTTATATGGGTGATCGTTTTCCAAG
TGGCATGCTAGCGACGTGGCTGGAATAAGCTATGGTCACCAGGCCTCATA
GCACATTGCTCCTTCGTAATGCGGCAATTCAATTCCTATATAACCTTTCT
AAAGCCCTCGCTACGATCAGAAATAAGCAGGCCGTGATTGAATTCTGGTA
GTAGACCTTATGCGACCGCGCGAAATTAGTAACCGAATCATTGATGGATT
GACTGCGAGATGGAGATTCCAGTATCATTCCTACAACCATGCTCAAGCTG
GGAAAAGCTGTGAATGAACAATTAGCAGAAGATAGGCCGTGATCAAGCCT
TGAGATGCAATGAATAGCAAAAATGTTTCAATACCTGCTATCACAATCTT
```

```
TGCAGACAGATTGTTACTAGGGTGGAAGGATATCTAGTTCTTTGGGAACA

ACACACTTTGCCTGATACATATCTTCTGGAGATTTCATTGTTCTTCTGGA

AAATGATCAGGGCAGGACTTTCATCCTCTTATAGTACATCATCTCCCAAT

AAACTAATGGTGGGACCGAGGCCAGCCCGGGGCATATAACCGACCCCAGA

GAGCCCGCGACCCCACGGTCGGCGACGTTCTCCGGTCGACGATGGCCTCA

AAAACCGGGGTCATCCCCCACGAAAATATCCCCAATTCACAACCAGCACC

AAGCCGCTGCTGGAATTG

TTGTGTGTAGTTAGGCTAGATGACAGTACTAAAATTAGCGGATCTGTTGG

GAATGATAATTGTAGTACAACTTCAACTTCGCTAGAAGGTCCAAAGGAAT

AAACTTACAGGAACAATGATGGGCTTTTTCACAACTGGGGCAAATTGTCT

AGCTTAAACAGCGCTCTTGGTTGCTGTTCAACCGTTCCTGGTATTATCGG

TCACCGGGCCTGCCAGCGAACAGTGTTAATATACCGAATGAGAAGCTTCC

AACAAACAAACGAAGAAGAATTGAAAAGAATGAAAGACTGCTGCAAAGCC

AGGTCTCAGAAGAAGGAAGAAAAGCCCAAGGGAAGGGAGGGGAAAAAAAC

CGACCTTACGTTAAAGCAAGGGGAAGATGAGATAACCTATCGTAAAGAAG

GCCGGACTTCGGAGGTTGCCCTGTGGCACGTGTCCCACTCCCAATCGGTC

AGTTACAGACCCTCAACAGAGCCTAAGGGTTATTTAGTGCACAGAATATG

AGATCCAGGACTATATAGGGACACCAGTTCACTCTGAGATGTTTGAACCA

GGCAGATCGGGCGGTAAGCAGAGAAAGAGGAACTTGGGAGAGGAGGAGAG

AAAGAGAGCTAACACGATACGTCGGTCCGATCCACGGGCCTCCTCCCAGA

CCCCTCATTCCTGCCATTGGCCTAAGGCCTTCGCCCGCCTTGCCCCTCCT

TGGGAAATTGCCTAAAAGAAAATCATAAAAAAAAAAAAGACCCATCGAT

CGTTGCTGATAACCGTCTTTTCCCCCAAAACAAGTCTCACCACCGAATCT

CACTACTCTGGACTATTTTTGTGTTTAACCAATTGAGGCTCCCAAATTAT

TAGCCTTGTTCCACTGAACCCTGAAATCTTCTATCAACACAAAAGTCGTC

GCAAGGAAGATCTACAACAATGTCCGCCGCTACCATCCCTGCTCCTGCCG

CCGAGCAAGACTACAAGGAGACATTGCTTCCCTTGTTGATGAAGAATAAC

GTCCTGTCCTTTGGCTCCTTTATCCTTAAGTCCGGCCGTGAATCTCCGTA

CTTCTTCACCTCTTCTCTCCTCCACACTGCGCCTTTGCTCCGTGCCACCT

CGGCAGCCTATGCCAGTGTCTTGTCTGCCCCGCCATTCGTAACTGTTGCG

GCGGACGGTACTACCACACCCAACTTCGACATTATCTTTGGCCCGGCTTA

TAAGGGCATTCCGGTGTGCGCTTCCGTTCTGAATGAATTAGCGGTGCGAG

ACTCTCTCTCCGCGTCTGCTAAGGGAACCTGGGACAATGTCAGCTACTCC

TTCAACCGTAAGGAGGCCAAGGACCACGGTGAAGGAGGAAACATTGTCGG

TGCTCCTCTGAAGGGAAAGCGTGTTGTCATTGTCGACGATGTTATCACAG

CTGGAACCGCCATCCGCGAGGCCGTGAGCATCATTCAGAAGGAAGGCGGT

ATTGTTACCGGCATTGTTGTCCTACTTGATCGCGAGGAAAGAGTCAGCGA

CGCTGAGCCTAAGAGCGCTATCGGCGTTGCACAGAGGGATCTTGG
 (SEQ ID NO: 39).

3-flank An07 00760/pyrE
1         10        20        30        40        50
|         |         |         |         |         |
ATCTCCGTACTTCTTCACCTCTTCTCTCCTCCACACTGCGCCTTTGCTCC
```

```
GTGCCACCTCGGCAGCCTATGCCAGTGTCTTGTCTGCCCCGCCATTCGTA
ACTGTTGCGGCGGACGGTACTACCACACCCAACTTCGACATTATCTTTGG
CCCGGCTTATAAGGGCATTCCGGTGTGCGCTTCCGTTCTGAATGAATTAG
CGGTGCGAGACTCTCTCTCCGCGTCTGCTAAGGGAACCTGGGACAATGTC
AGCTACTCCTTCAACCGTAAGGAGGCCAAGGACCACGGTGAAGGAGGAAA
CATTGTCGGTGCTCCTCTGAAGGGAAAGCGTGTTGTCATTGTCGACGATG
TTATCACAGCTGGAACCGCCATCCGCGAGGCCGTGAGCATCATTCAGAAG
GAAGGCGGTATTGTTACCGGCATTGTTGTCCTACTTGATCGCGAGGAAAG
AGTCAGCGACGCTGAGCCTAAGAGCGCTATCGGCGTTGCACAGAGGGATC
TTGGTGAAAACATCCCCATTCGCGCAGTGATTGGTCTTCACGACTTGATC
GAAAAGCTGGGTGATAAGATCGGGGAGTCCGAGATCCAGCGCTTGAAGGA
TTACAGGGCTCGCTACGGAGCCGAATAGATCCGGTGCATTAGCATTATAG
GCAAAAATAGACGACGAAATGATCATATTTTTCTTGTAAATACGCTGAT
TTGGCGCACATTCCTTCCCCGTTGTCGGTGTATCGAAAATCGGGTGAAGA
GGCATTTCTTACGTTCTTTTTTGGATTATCTTTTTATTTATAGATTCAA
TAGTGTCAATTTTTAATTGACATGGCTTATGTAGCATGCCCATGTATGTA
CGACTGCTTTTACGATAAATGACTCAATATAGAACTTGTTACGTGCATCG
TTATATATATCTTGGCGAACGTTTTGCCATTCTGAGCAACAATTTGACTG
GCATATGGGGCAGCTACACTAACATGTGTAGATTTATGAAGACTAGATCT
GTTATTAGTAGAAATTTACAAGAATATATTGAGAATGTACTTAAGTAGCA
CATGTTCCGGTTTCAGTTAAATGCCTACACAAGCATATACAGTTGCTCAC
TATATCAAAATGGATAGACATAGTATATATACATGTCCCTTCAAGAATCT
TTCATATGAGATTCCTGCGGAATATACTTTAAAGGATTGATTGGAATGCA
TCTGTTAGATTTGCCACAGGCCTCGCAATCAAATCATCTACT
AAGCCGCTGCTGGAATTG
GTAGACCT
TATGCGACCGCGCGAAATTAGTAACCGAATCATTGATGGATTGACTGCGA
GATGGAGATTCCAGTATCATTCCTACAACCATGCTCAAGCTGGGAAAAGC
TGTGAATGAACAATTAGCAGAAGATAGGCCGTGATCAAGCCTTGAGATGC
AATGAATAGCAAAAATGTTTCAATACCTGCTATCACAATCTTTGCAGACA
GATTGTTACTAGGGTGGAAGGATATCTAGTTCTTTGGGAACAACACACTT
TGCCTGATACATATCTTCTGGAGATTTCATTGTTCTTCTGGAAAATGATC
AGGGCAGGACTTTCATCCTCTTATAGTACATCATCTCCCAATAAACTAAT
GGTGGGACCGAGGCCAGCCCGGGGCATATAACCGACCCCAGAGAGCCCGC
GACCCCACGGTCGGCGACGTTCTCCGGTCGACGATGGCCTCAAAAACCGG
GGTCATCCCCCACGAAAATATCCCCAATTCACAACCAGCACC
ACACGGCACAATTATCCATCG
ATATCTC
CATGTTGGAGAGCATGGTTGAGTGGATGGGCTTCCCTATGTATTATACTTA
TGAGAATGCCCCGGGCCCGACACCAGCGGGTGCTTCGCATGCGGCTATCT
```

```
ATCCTTATGGCCCGTTTGAGACGGGAGATGGAACGGTGATGTTGGGGATC

CAGAATGAGCGTGAGTGGGCTAAGTTCTGTGACATCGTCTTGGGTCAACC

CAGTCTTGCTACGAATGAGCGGTTTGTGAATAACTCGCTGCGCTCGCAGA

ACCGTGATGAGTTGAAGAAGATAATCTGTGACGTCTTCTCGTCGCTTTCG

GCGGAGCAGGTGATTGCTCGACTGGATGCAGCGGCGATTGCTAATGCCAG

CGTCAATGATATGCAAGGCGTCTGGAACCACCCACAGCTCAAGGCTCGGC

AGCGATGGACAGATGTTAAGACGCCCGCAGGAAGTGTGCCGGCTCTGCTA

CCTCCTGGAATGACCATGGGGGATGAGGATACTTATGGGGCGCGCATGGA

CGCTGTCCCTGATGTGGGTGAGCATAACAAGGCTATTCTGGCCGAGTTGG

GGCTCGACGAGGGTACGGAGAAATAGCTGCAGTTGAATTAATGACATGTA

GACTTGAGCTAGTGGACTTGGCTATCCTTGCGAGTATTGGAACTTTTAGG

CCCTTTGTAAATAACTCAGTGCGATGGATTCACCTCGGGCAATTCTACTG

TCCACTCACGAGGTTGAAGATACCTGCATGTCAAAGGATGTTCAGACGTA

GAACTAGTCGACCACAATATGGATCTTAGACTTTAATCCAATTCAGGCAA

CCTACCCCTGCTGCCCCTAATATCACCCCGCGACGGTATCCAGCGTAAAG

TGAATATCGGCGCAATATACCCATCGCCGAAGCAAGTGGATCGGGAAAAC

AGGCAAAAAGCCGACATGCCCGCCAAGACCGAGGCAGCATAAAGCCGCTT

TATCCTCGACTACGGCTACTTGCATTCTGCCTGGCCACCTCTGAACTCCA

CTGTGGACGATCTCTTTCATTGGTAATTGGAGCTAATTCGAG
(SEQ ID NO: 40).

5-flank-ICT-HygB
CGCTAATATACCCTTCACGGCCAGTCCTCAGTTTGGCCTAGATTTACAAT

TCCGTCCGCACTAAAGAATGCAGACCGAGTATTGACTTGGGCATCAGTTC

TGCTCAGGTCATAGCACAAATGCTTCTGATCGGAGAATTTCGGATGTATC

CGAAACATCTGCTTGCGGCTGCACACCGACATGAAAAAGGCACGTCTCAT

TCATCGGAATATTCCCCGTCTCAAAGTTGGTGACGTGAACGGCACATTAA

CCCCACCAATCAGACGCCAGGGAGGCCTGATGCTAGCCCGATGATCGTCA

AGCGAGTTCCCTGGACGATGCCGTCCTCCCCGATGGAACAGCCATTATCC

ATCTGCTGGATGGGAATACTAGCCCGTTGAACCGAGCTACTTCAGGAACA

GATGTTCAAGTGTGACCTTCCCGTCTTTAAGTAGTATAGCTTCACAATTG

GGGGTTAAGGCTGCTTGTGTCCCTTGTAAGTGACCGACATCAGCAATGGC

CGTTATGACGACCCTCCGGTATTTGGTCGCATACGAGGTGCAGTAGTACA

GCATATTAGACCAAAAGCCTCCAGGGTGCTTGCATTGGGATGAACATCGT

CCAGGATCACCTCCGGCGGTATCCAGCAGGTGTTCAGCCGAATAGCCCCG

TGGCTGTATTTGGCAGGGAGTATCCTTGTCGGTTTGCATATAGGTAGCTG

TCTAGAACTTGTGAGTTCGAGCTGCGCAGTTATATGGGTGATCGTTTTCC

AAGTGGCATGCTAGCGACGTGGCTGGAATAAGCTATGGTCACCAGGCCTC

ATAGCACATTGCTCCTTCGTAATGCGGCAATTCAATTCCTATATAACCTT

TCTAAAGCCCTCGCTACGATCAGAAATAAGCAGGCCGTGATTGAATTCTG

GTAGTAGACCTTATGCGACCGCGCGAAATTAGTAACCGAATCATTGATGG

ATTGACTGCGAGATGGAGATTCCAGTATCATTCCTACAACCATGCTCAAG

CTGGGAAAAGCTGTGAATGAACAATTAGCAGAAGATAGGCCGTGATCAAG
```

```
CCTTGAGATGCAATGAATAGCAAAAATGTTTCAATACCTGCTATCACAAT
CTTTGCAGACAGATTGTTACTAGGGTGGAAGGATATCTAGTTCTTTGGGA
ACAACACACTTTGCCTGATACATATCTTCTGGAGATTTCATTGTTCTTCT
GGAAAATGATCAGGGCAGGACTTTCATCCTCTTATAGTACATCATCTCCC
AATAAACTAATGGIGGGACCGAGGCCAGCCCGGGGCATATAACCGACCCC
AGAGAGCCCGCGACCCCACGGTCGGCGACGTTCTCCGGTCGACGATGGCC
TCAAAAACCGGGGTCATCCCCCACGAAAATATCCCCAATTCACAACCAGC
ACCCTGTACAGTGACCGGTGACTCTTTCTGGCATGCGGAGAGACGGACGG
ACGCAGAGAGAAGGGCTGAGTAATAAGCGCCACTGCGCCAGACAGCTCTG
GCGGCTCTGAGGTGCAGTGGATGATTATTAATCCGGGACCGGCCGCCCCT
CCGCCCCGAAGTGGAAAGGCTGGTGTGCCCCTCGTTGACCAAGAATCTAT
TGCATCATCGGAGAATATGGAGCTTCATCGAATCACCGGCAGTAAGCGAA
GGAGAATGTGAAGCCAGGGGTGTATAGCCGTCGGCGAAATAGCATGCCAT
TAACCTAGGTACAGAAGTCCAATTGCTTCCGATCTGGTAAAAGATTCACG
AGATAGTACCTTCTCCGAAGTAGGTAGAGCGAGTACCCGGCGCGTAAGCT
CCCTAATTGGCCCATCCGGCATCTGTAGGGCGTCCAAATATCGTGCCTCT
CCTGCTTTGCCCGGTGTATGAAACCGGAAAGGCCGCTCAGGAGCTGGCCA
GCGGCGCAGACCGGGAACACAAGCTGGCAGTCGACCCATCCGGTGCTCTG
CACTCGACCTGCTGAGGTCCCTCAGTCCCTGGTAGGCAGCTTTGCCCCGT
CTGTCCGCCCGGTGTGTCGGCGGGGTTGACAAGGTCGTTGCGTCAGTCCA
ACATTTGTTGCCATATTTTCCTGCTCTCCCCACCAGCTGCTCTTTTCTTT
TCTCTTTCTTTTCCCATCTTCAGTATATTCATCTTCCCATCCAAGAACCT
TTATTTCCCCTAAGTAAGTACTTTGCTACATCCATACTCCATCCTTCCCA
TCCCTTATTCCTTTGAACCTTTCAGTTCGAGCTTTCCCACTTCATCGCAG
CTTGACTAACAGCTACCCCGCTTGAGCAGACATCACCATGCCTGAACTCA
CCGCGACGTCTGTCGAGAAGTTTCTGATCGAAAAGTTCGACAGCGTCTCC
GACCTGATGCAGCTCTCGGAGGGCGAAGAATCTCGTGCTTTCAGCTTCGA
TGTAGGAGGGCGTGGATATGTCCTGCGGGTAAATAGCTGCGCCGATGGTT
TCTACAAAGATCGTTATGTTTATCGGCACTTTGCATCGGCCGCGCTCCCG
ATTCCGGAAGTGCTTGACATTGGGGAATTCAGCGAGAGCCTGACCTATTG
CATCTCCCGCCGTGCACAGGGTGTCACGTTGCAAGACCTGCCTGAAACCG
AACTGCCCGCTGTTCTGCAGCCGGTCGCGGAGGCCATGGATGCGATCGCT
GCGGCCGATCTTAGCCAGACGAGCGGGTTCGGCCCATTCGGACCGCAAGG
AATCGGICAATACACTACATGGCGTGATTICATATGCGCGATTGCTGATC
CCCATGTGTATCACTGGCAAACTGTGATGGACGACACCGTCAGTGCGTCC
GTCGCGCAGGCTCTCGATGAGCTGATGCTTTGGGCCGAGGACTGCCCCGA
AGTCCGGCACCTCGTGCACGCGGATTTCGGCTCCAACAATGTCCTG
(SEQ ID NO: 41).

3-flank-ICT-HygB
GGTTTCTACAAAGATCGTTATGTTTATCGGCACTTTGCATCGGCCGCGCT
CCCGATTCCGGAAGTGCTTGACATTGGGGAATTCAGCGAGAGCCTGACCT
```

-continued

```
ATTGCATCTCCCGCCGTGCACAGGGTGTCACGTTGCAAGACCTGCCTGAA

ACCGAACTGCCCGCTGTTCTGCAGCCGGTCGCGGAGGCCATGGATGCGAT

CGCTGCGGCCGATCTTAGCCAGACGAGCGGGTTCGGCCCATTCGGACCGC

AAGGAATCGGTCAATACACTACATGGCGTGATTTCATATGCGCGATTGCT

GATCCCCATGTGTATCACTGGCAAACTGTGATGGACGACACCGTCAGTGC

GTCCGTCGCGCAGGCTCTCGATGAGCTGATGCTTTGGGCCGAGGACTGCC

CCGAAGTCCGGCACCTCGTGCACGCGGATTTCGGCTCCAACAATGTCCTG

ACGGACAATGGCCGCATAACAGCGGTCATTGACTGGAGCGAGGCGATGTT

CGGGGATTCCCAATACGAGGTCGCCAACATCTTCTTCTGGAGGCCGTGGT

TGGCTTGTATGGAGCAGCAGACGCGCTACTTCGAGCGGAGGCATCCGGAG

CTTGCAGGATCGCCGCGGCTCCGGGCGTATATGCTCCGCATTGGTCTTGA

CCAACTCTATCAGAGCTTGGTTGACGGCAATTTCGATGATGCAGCTTGGG

CGCAGGGTCGATGCGACGCAATCGTCCGATCCGGAGCCGGGACTGTCGGG

CGTACACAAATCGCCCGCAGAAGCGCGGCCGTCTGGACCGATGGCTGTGT

AGAAGTACTCGCCGATAGTGGAAACCGACGCCCCAGCACTCGTCCGAGGG

CAAAGGAATAGTGATTTAATAGCTCCATGTCAACAAGAATAAAACGCGTT

TCGGGTTTACCTCTTCCAGATACAGCTCATCTGCAATGCATTAATGCATT

GGACCTCGCAACCCTAGTACGCCCTTCAGGCTCCGGCGAAGCAGAAGAAT

AGCTTAGCAGAGTCTATTTTCATTTTCGGGAGACGAGATCAAGCAGATCA

ACGGTCGTCAAGAGACCTACGAGACTGAGGAATCCGCTCTTGGCTCCACG

CGACTATATATTTGTCTCTAATTGTACTTTGACATGCTCCTCTTCTTTAC

TCTGATAGCTTGACTATGAAAATTCCGTCACCAGCCCCTGGGTTCGCAAA

GATAATTGCACTGTTTCTTCCTTGAACTCTCAAGCCTACAGGACACACAT

TCATCGTAGGTATAAACCTCGAAAATCATTCCTACTAAGATGGGTATACA

ATAGTAACCATGCATGGTTGCCTAGTGAATGCTCCGTAACACCCAATACG

CCGGCCGAAACTTTTTTACAACTCTCCTATGAGTCGTTTACCCAGAATGC

ACAGGTACACTTGTTTAGAGGTAATCCTTCTTTCTAGAAGTCCTCGTGTA

CTGTGTAAGCGCCCACTCCACATCTCCACTCGAGCCTTATCTCCATGTTG

GAGAGCATGGTTGAGTGGATGGGCTTCCCTATGTATTATACTTATGAGAA

TGCCCCGGGCCCGACACCAGCGGGTGCTTCGCATGCGGCTATCTATCCTT

ATGGCCCGTTTGAGACGGGAGATGGAACGGTGATGTTGGGGATCCAGAAT

GAGCGTGAGTGGGCTAAGTTCTGTGACATCGTCTTGGGTCAACCCAGTCT

TGCTACGAATGAGCGGTTTGTGAATAACTCGCTGCGCTCGCAGAACCGTG

ATGAGTTGAAGAAGATAATCTGTGACGTCTTCTCGTCGCTTTCGGCGGAG

CAGGTGATTGCTCGACTGGATGCAGCGGCGATTGCTAATGCCAGCGTCAA

TGATATGCAAGGCGTCTGGAACCACCCACAGCTCAAGGCTCGGCAGCGAT

GGACAGATGTTAAGACGCCCGCAGGAAGTGTGCCGGCTCTGCTACCTCCT

GGAATGACCATGGGGGATGAGGATACTTATGGGGCGCGCATGGACGCTGT

CCCTGATGTGGGTGAGCATAACAAGGCTATTCTGGCCGAGTTGGGGCTCG

ACGAGGGTACGGAGAAATAGCTGCAGTTGAATTAATGACATGTACAGTTG

AGCTAGTGGACTTGGCTATCCTTGCGAGTATTGGAACTTTTAGGCCCTTT
```

```
GTAAATAACTCAGTGCGATGGATTCACCTCGGGCAATTCTACTGTCCACT

CACGAGGTTGAAGATACCTGCATGTCAAAGGATGTTCAGACGTAGAACTA

GTCGACCACAATATGGATCTTACAGTTTAATCCAATTCAGGCAACCTACC

CCTGCTGCCCCTAATATCACCCCGCGACGGTATCCAGCGTAAAGTGAATA

TCGGCGCAATATACCCATCGCCGAAGCAAGTGGATCGGGAAAACAGGCAA

AAAGCCGACATGCCCGCCAAGACCGAGGCAGCATAAAGCCGCTTTATCCT

CGACTACGGCTACTTGCATTCTGCCTGGCCACCTCTGAACTCCACTGTGG

ACGATCTCTTTCATTGGTAATTGGAGCTAATTCGAGGATCATGTCCAGTC

AGGAGTCATCGGGCCACCGACAGGTAAGAACCAGGGCCAAGCAGGCTTGT

CTCCACTGCAATAAGCGGCGAATCCGCTGCAATGTGCTACAGATGCGCCC

ATGCCAGAATTGTCTGGCATTGAATGTACCCTGTGAGA (SEQ ID NO: 42).
```

5-flank_TmtA
```
   1 ATAGCTTTAT CGATATTTAC CACCCAATTC ATTCCAAGTG TGGATTCATA CCCTCGTCGT
  61 CCCCTTAAAA CTGTGCCCGA AGACATCACG CCTGCAGATC ATGAGATCCT ACTGCGCGGC
 121 GGCACATCTT CTAACATTAA ATGATTTCCT TCACGCCTGC AAAGATCAAA ACGTGCATCT
 181 GCAGATCTGC ATCACCACTT AGAGGATCTA ACGTACGAAG TCAGCTATCT TAAGGCCGAG
 241 CTTCAGTGGG AGAAAGAATC GAAGTAGATC CTCTTGTGTT TCCAGGACGA CATGTTCCGT
 301 CTCTTTCATC AGCCGGAAAT GGCTCTGGCT CAAGTCAGCG CAAGATTGAA GGACTGTGAA
 361 AAGCATTACT ATGAATCATG GGGCTTTTCC ACTACTTCAA CTGAAGAAGG AATGATCTAA
 421 GGAGCTCAGG GCTATCGAGT ACGGTACGAC TTGTACACGA TGATATGGTA TGCAAGCGAA
 481 TACATCACTG GCAGTAATCT AAATATCGAA TACTTAGCCC CCATAGAAGA ACCGCAGCTG
 541 CGTTTAGTCT ATTGGAAGAC TCTAGTGTCT GGTGAAAGGA CGATTAAGTC CGAATAACTG
 601 CCCAGTAACA TAGAGAGTGG CCTATATTGG TCAAACGTCT GAAGAGGGGA ATTCTATGCT
 661 TGCGGCCTCA TTTGATGTCA AGCTTAGCAC GGATAAAAGC GTGTTTAGTA TGTGTATGCT
 721 GTTTCTTCCC CTGGTCTAAT TTGAAGTGCT ATGTTCTTCA TTCTATCTCT TCATACTCTT
 781 AGAAGGTTCT AATTATCCTA TCGTCCTCTC ATCTCTAGAT CTGGACTATA TAGGCGTCAA
 841 TTGAGTGACA GTGGCATGGT GATTATTGGC AGTATAAAGA TATTTGTCTA TATTATAAGC
 901 GACTGATGGC AACGCGCCCA CCTGACTATT TCGGTAGACT TGAATTAGCA GGATACTGTA
 961 TCTTACGGTT GATATTTAAT TAGTGCGAGA ATTAGCGATA TGACAACGCG GAATAGCTAT
1021 CCCTGGCTGA AGTTCTGCCC TTCAATCTTC GAGGTGTAAT CCAGCGGCAA CATCCGTTGA
1081 ACACGTGCGG GGTGGAAGTC CCCGACGAAC TTGTCGACGC GACGAAATCT GTATGTTTTC
1141 AGAGTAACCT CACGTATCCG CGTCTTCCGG GTTGACAGCA TAAGATGATA TCAGTGTAAT
1201 ATAATAAGTA AGCAAGTAAG CAGGGCTGAC GAAGATTGTT CCTATCCCGT GATACTTTAA
1261 CAGAGAAGCC AATCATGTTT CCGCCGAAAC CGGCACTTTC GAGGTACCAC CACCACTATA
1321 ACATCATCCC ACTTATATAC CTCACAACAA TATAAATACT GAAGTTCCTA TACATCGTCA
1381 ACACTAACAA CACATCCATC TACAACCACC AGCTGTTAAA CATCAATTGT GTGTAGTTAG
1441 GCTAGATGAC AGTACTAAAA TTAGCGGATC TGTTGGGAAT GATAATTGTA GTACAACTTC
1501 AACTTCGCTA GAAGGTCCAA AGGAATAAAC TTACAGGAAC AATGATGGGC TTTTTCACAA
1561 CTGGGGCAAA TTGTCTAGCT TAAACAGCGC TCTTGGTTGC TGTTCAACCG TTCCTGGTAT
1621 TATCGGTCAC CGGGCCTGCC AGCGAACAGT GTTAATATAC CGAATGAGAA GCTTCCAACA
1681 AACAAACGAA GAAGAATTGA AAGAATGAA AGACTGCTGC AAAGCCAGGT CTCAGAAGAA
```

-continued

```
1741 GGAAGAAAAG CCCAAGGGAA GGGAGGGGAA AAAAACCGAC CTTACGTTAA AGCAAGGGGA

1801 AGATGAGATA ACCTATCGTA AAGAAGGCCG GACTTCGGAG GTTGCCCTGT GGCACGTGTC

1861 CCACTCCCAA TCGGTCAGTT ACAGACCCTC AACAGAGCCT AAGGGTTATT TAGTGCACAG

1921 AATATGAGAT CCAGGACTAT ATAGGGACAC CAGTTCACTC TGAGATGTTT GAACCAGGCA

1981 GATCGGGCGG TAAGCAGAGA AAGAGGAACT TGGGAGAGGA GGAGAGAAAG AGAGCTAACA

2041 CGATACGTCG GTCCGATCCA CGGGCCTCCT CCCAGACCCC TCATTCCTGC CATTGGCCTA

2101 AGGCCTTCGC CCGCCTTGCC CCTCCTTGGG AAATTGCCTA AAAGAAAATC ATAAAAAAAA

2161 AAAAAGACCC ATCGATCGTT GCTGATAACC GTCTTTTCCC CCAAAACAAG TCTCACCACC

2221 GAATCTCACT ACTCTGGACT ATTTTTGTGT TTAACCAATT GAGGCTCCCA AATTATTAGC

2281 CTTGTTCCAC TGAACCCTGA AATCTTCTAT CAACACAAAA GTCGTCGCAA GGAAGATCTA

2341 CAACAATGTC CGCCGCTACC ATCCCTGCTC CTGCCGCCGA GCAAGACTAC AAGGAGACAT

2401 TGCTTCCCTT GTTGATGAAG AATAACGTCC TGTCCTTTGG CTCCTTTATC CTTAAGTCCG

2461 GCCGTGAATC TCCGTACTTC TTCACCTCTT CTCTCCTCCA CACTGCGCCT TTGCTCCGTG

2521 CCACCTCGGC AGCCTATGCC AGTGTCTTGT CTGCCCCGCC ATTCGTAACT GTTGCGGCGG

2581 ACGGTACTAC CACACCCAAC TTCGACATTA TCTTTGGCCC GGCTTATAAG GGCATTCCGG

2641 TGTGCGCTTC CGTTCTGAAT GAATTAGCGG TGCGAGACTC TCTCTCCGCG TCTGCTAAGG

2701 GAACCTGGGA CAATGTCAGC TACTCCTTCA ACCGTAAGGA GGCCAAGGAC CACGGTGAAG

2761 GAGGAAACAT TGTCGGTGCT CCTCTGAAGG GAAAGCGTGT TGTCATTGTC GACGATGTTA

2821 TCACAGCTGG AACCGCCATC CGCGAGGCCG TGAGCATCAT TCAGAAGGAA GGCGGTATTG

2881 TTACCGGCAT TGTTGTCCTA CTTGATCGCG AGGAAAGAGT CAGCGACGCT GAGCCTAAGA

2941 GCGCTATCGG CGTTGCACAG AGGGATCTTG G  (SEQ ID NO: 43).
```
3-flank_TmtA
```
   1 ATCTCCGTAC TTCTTCACCT CTTCTCTCCT CCACACTGCG CCTTTGCTCC GTGCCACCTC

61 GGCAGCCTAT GCCAGTGTCT TGTCTGCCCC GCCATTCGTA ACTGTTGCGG CGGACGGTAC

121 TACCACACCC AACTTCGACA TTATCTTTGG CCCGGCTTAT AAGGGCATTC CGGTGTGCGC

181 TTCCGTTCTG AATGAATTAG CGGTGCGAGA CTCTCTCTCC GCGTCTGCTA AGGGAACCTG

241 GGACAATGTC AGCTACTCCT TCAACCGTAA GGAGGCCAAG GACCACGGTG AAGGAGGAAA

301 CATTGTCGGT GCTCCTCTGA AGGGAAAGCG TGTTGTCATT GTCGACGATG TTATCACAGC

361 TGGAACCGCC ATCCGCGAGG CCGTGAGCAT CATTCAGAAG GAAGGCGGTA TTGTTACCGG

421 CATTGTTGTC CTACTTGATC GCGAGGAAAG AGTCAGCGAC GCTGAGCCTA AGAGCGCTAT

481 CGGCGTTGCA CAGAGGGATC TTGGTGAAAA CATCCCCATT CGCGCAGTGA TTGGTCTTCA

541 CGACTTGATC GAAAAGCTGG GTGATAAGAT CGGGGAGTCC GAGATCCAGC GCTTGAAGGA

601 TTACAGGGCT CGCTACGAG CCGAATAGAT CCGGTGCATT AGCATTATAG GCAAAAAATA

661 GACGACGAAA TGATCATATT TTTCTTGTAA ATACGCTGAT TTGGCGCACA TTCCTTCCCC

721 GTTGTCGGTG TATCGAAAAT CGGGTGAAGA GGCATTTCTT ACGTTCTTTT TTGGATTATC

781 TTTTTTATTT ATAGATTCAA TAGTGTCAAT TTTTAATTGA CATGGCTTAT GTAGCATGCC

841 CATGTATGTA CGACTGCTTT TACGATAAAT GACTCAATAT AGAACTTGTT ACGTGCATCG
```

```
 901 TTATATATAT CTTGGCGAAC GTTTTGCCAT TCTGAGCAAC AATTTGACTG GCATATGGGG

961 CAGCTACACT AACATGTGTA GATTTATGAA GACTAGATCT GTTATTAGTA GAAATTTACA

1021 AGAATATATT GAGAATGTAC TTAAGTAGCA CATGTTCCGG TTTCAGTTAA ATGCCTACAC

1081 AAGCATATAC AGTTGCTCAC TATATCAAAA TGGATAGACA TAGTATATAT ACATGTCCCT

1141 TCAAGAATCT TTCATATGAG ATTCCTGCGG AATATACTTT AAAGGATTGA TTGGAATGCA

1201 TCTGTTAGAT TTGCCACAGG CCTCGCAATC AAATCATCTA CTTATTTCGG TAGACTTGAA

1261 TTAGCAGGAT ACTGTATCTT ACGGTTGATA TTTAATTAGT GCGAGAATTA GCGATATGAC

1321 AACGCGGAAT AGCTATCCCT GGCTGAAGTT CTGCCCTTCA ATCTTCGAGG TGTAATCCAG

1381 CGGCAACATC CGTTGAACAC GTGCGGGGTG GAAGTCCCCG ACGAACTTGT CGACGCGACG

1441 AAATCTGTAT GTTTTCAGAG TAACCTCACG TATCCGCGTC TTCCGGGTTG ACAGCATAAG

1501 ATGATATCAG TGTAATATAA TAAGTAAGCA AGTAAGCAGG GCTGACGAAG ATTGTTCCTA

1561 TCCCGTGATA CTTTAACAGA GAAGCCAATC ATGTTTCCGC CGAAACCGGC ACTTTCGAGG

1621 TACCACCACC ACTATAACAT CATCCCACTT ATATACCTCA CAACAATATA AATACTGAAG

1681 TTCCTATACA TCGTCAACAC TAACAACACA TCCATCTACA ACCACCAGCT GTTAAACATC

1741 AACGGGGTTG AGGCCGTATT TGGATGGGTT GAGGGGAGAG GAGGAACGGG GGGAGTTTTT

1801 GAAGGTGTAT GAGGAGAAAT TGAGGGAGAA GTATGAGAAA AGGGCTGATG GGAGGGTATT

1861 GTTGAGGTAT CCCAGGTTGT TTGCTGTTGC TGTTCGGAAG TGATTTTCTT CTCTTGTTTA

1921 TTTACGAGAT TGGGTTTGGA GGTGCAGTGT ATAGGTAGAG GACAGAATGG AGGATGCTCT

1981 GATCATGTCA TCCAAGCTTC CAGTGTATAT GGCAGGCATG CATGCTGGTA TAATCCTAAG

2041 TTTATAGCTC GCATATGGAA TATATCGTCA GGTCCATGTA AGCCGTCACG CAGGTACATA

2101 GCTTGGCCTA GCAAGCTTAT AGCTGGACTG AACCACCTCA ATTGATCCTG TGATACAAAT

2161 TAAAATGCAT GACTCAAACA GTTTCACCAG AAATCTCGCC AGCGCTCGAT CATTCCCCGG

2221 ACGCCATCAA GTTAGAATGC TGAGATTGAA AGCGGGACAC GAACAAGGAA CGCAGTTACA

2281 CAGAACCACA TTACCACCTG GTTCAATGCC AATTACATAA TTGCAAAATG GTACAGATCG

2341 TCAATCCATG CATAATAGCA TTGTCTATAC CCCAGCTTCA TCGAAATAGA TCACTTACTG

2401 CAGACTCCCT CCTTCACAGC ATACCCGACG GCCATCCCGA TCAAGGGGAC CGAATGCCCC

2461 GGAATCATCA ACCCACATTC CACGCCCCCT TATATTACCA CAAATCTCCA CTACAATCCC

2521 CGCGTTCAAG GAACGCCCCT TAGCTAACCC AAACAAGGGC GCGTCAACAA ACCGACCGCC

2581 ATACGGCGTA ACATGCCTCA TTCCGCCCTG AAGAACTGAT TCCCCACCAA TACCTTACTG

2641 CGGAAATCAT TTACCCGGAG TATCCAGGCA CAATCCAATC AAGCCATGCA TGCACCCACG

2701 CAGGTGTACA CAGGCATGCC TTGAAGATGC CAACGCGTTC GCTTATTTCC TCCTTCTCTC

2761 CCCTCCCTTG AAGAATCGAA TATAAAATCC AGCTTGATAT CCACGACAGA TTCTCTTTTT

2821 CATCCATCAG CAACAATCAC AGCAGCAGTC TAGCAGCCAA TACTTTCTCT TCCACGACAA

2881 CAATCAAAAT GCAATTCACC ACCTTCCTTT CCCTGGCCAT CGCGGCCGTC GTTCCCGCTC

2941 TGGCTGCGGA CAACGCTGCT CAGGAGA (SEQ ID NO: 44).
```

SEQUENCE LISTING (210 sequences)

SEQ ID NO: 1 - protein, 9 aa, Artificial Sequence
  target for endonuclease
LAGLIDADG

SEQ ID NO: 2 - protein, 417 aa, Aspergillus niger
MPNTRPLVRAACHNLSGMRHASTSATKKAGPLAGITVVSLEQAIAAPFCTRQLADLGARVIKVERPGVGDFARNYDTRVNGLASHFVWTNRSKESLALDLKKPSDHSVLMRLLGRADVLVQNLAPGASARLGLSYDDLKAAHPSLIVCNISGYGPDGPYRDKKAYDLLIQSEAGMLSVTGTGKEPAKVGISIADISAGSYAYSNILAALYQRERDPSKRGCNIDISMLESMVEWMGFPMYYTYENAPGPTPAGASHAAIYPYGPFETGDGTVMLGIQNEREWAKFCDIVLGQPSLATNERFVNNSLRSQNRDELKKIICDVFSSLSAEQVIARLDAAAIANASVNDMQGVWNHPQLKARQRWTDVKTPAGSVPALLPPGMTMGDEDTYGARMDAVPDVGEHNKAILAELGLDEGTEK

SEQ ID NO: 3 - protein, 400 aa, Aspergillus niger
MRHASTSATKKAGPLAGITVVSLEQAIAAPFCTRQLADLGARVIKVERPGVGDFARNYDTRVNGLASHFVWTNRSKESLALDLKKPSDHSVLMRLLGRADVLVQNLAPGASARLGLSYDDLKAAHPSLIVCNISGYGPDGPYRDKKAYDLLIQSEAGMLSVTGTGKEPAKVGISIADISAGSYAYSNILAALYQRERDPSKRGCNIDISMLESMVEWMGFPMYYTYENAPGPTPAGASHAAIYPYGPFETGDGTVMLGIQNEREWAKFCDIVLGQPSLATNERFVNNSLRSQNRDELKKIICDVFSSLSAEQVIARLDAAAIANASVNDMQGVWNHPQLKARQRWTDVKTPAGSVPALLPPGMTMGDEDTYGARMDAVPDVGEHNKAILAELGLDEGTEK

SEQ ID NO: 4 - protein, 414 aa, Aspergillus terreus
MSLSRPLARAWAQTLAPSTRRHTSTQAGKTGPLTGITVVSLEQAIAAPFCTRQLADLGARVIKVERPGVGDFARNYDTRVNGLASHFVWTNRSKESLALDVKKPRDHQVLMRLLSKADVLVQNLAPGASARLGLSHEDLKATNPSLIVCNISGYGPDGPYRDKKAYDLLIQSEAGMLSVTGTGKEPAKVGISIADISAGCYAYSNILAALIQRDKDPKRRGCNIDISMLESMVEWMGFPMYYTYANAPGPTPTGASHAAIYPYGPFETGDGSVMLGIQNEREWTNFCDKVLGKPELATDSRFANNSLRSQNREELKIIICEVFSSLTADQVIARLDGASIANASVNDMQGVWKHPQLKARGRWTEIETPAGTVPALFPPGMDASANFAARMDAVPAVGEHNESILAELGMKESK

SEQ ID NO: 5 - protein, 361 aa, Aspergillus niger
MSLPSITRCSTRHLLRPQSLTPQLTRTFSIRPALRTDTSASTIATSFLTRFQSLGPQTRSQTLDANQLQLLSLTLNRPSLFPNSPSLSNTPTSLPTGTPLPAGYHLVYFTPAFLENELGADGTDTSYNPASPFTRRMWAGGEVHWPRGKDGKPNCLRVGQEVQETTRVLSAEPKVVRKTGEEMIVVGVEKEFRNENGVAVLDRRNWVFRKALTSPSPTSSSTPPATKAFNGPASSSTETSENVHTRTLRQTAVTLFRFSALTFNPHKIHYSTPWARDVEGHKDIVVHGPLNLISILDLWRDTRKNGSGEEVVLPEKISYRATSPLYAEEEYRIVLEDGEDGIGRVQIIAPGEVVAMKAEIQ

SEQ ID NO: 6 - protein, 361 aa, Aspergillus niger
MSLPSITRSSTRTLLRPQTVTPQLTRAFSIRPALRTDTSASTIATSFLTRFQSLGPQTRSQILDANQLRLLSLTLNRPSLFPNSPSLSNTPTSLPTGTPLPAGYHLVYFTPAFLENELGADGTDTSYNPASPFTRRMWAGGEVHWPRGKDGKPNYLRVGQEVQETTRVLSAEPKVVRKTGEEMIVVGVEKEFRNEDGVAVLDRRNWVFRKALTSPSPTSSSTPPATKAFNGPASSSTETSENVHTRTLRQTAVTLFRFSALTFNPHKIHYSTPWARDVEGHKDIVVHGPLNLISILHLWRDTRKNGSGEEVVLPEKISYRATSPLYAEEEYRIVLEDGEDGIGRVQIVAPGEVVAMKAEIQ

SEQ ID NO: 7 - protein, 364 aa, Aspergillus terreus
MSIHTSARWAMRSVPPLTQGCAALRRFSVQHSCRSAPEATAPSVAASFLSRFQSMGPQTRSQVLDANQLQLLSLTLNRPSLYPNSPSLSNASGVVPTGTPLPPAYHLVYFTPAFLEGELGADGTDVSYNPEPPFTRRMWAGGEVQWPRGADGKPNPLRVGQEVQETTRVLSAEPKIIRKTGDEMIVVSVEKEFRNEHGVAVIDRRNWVFRKALALASSPVSASPISVHLPALPASCSTSTVGKTHTRTLRQTAVTLFRFSALTFNPHKIHYSTPWARDVEGHKDIVVHGPLNLISILDLWRDTRADSATDSSLLLPESISYRATSPLYAEETYRIVLDEEQGDGVSRVQIFTPDEKVAMKAEIR

SEQ ID NO: 8 - protein, 323 aa, Aspergillus niger
MAARNTLRRALLYIPGSSQRFIDKSRTLTADCVAYDLEDSVTPHKKAEARSLVRRALDEPAPQGIRERAVRINSVDSGLALGDLTEVLKSPNLTTIVIPKVNTPSDLTFVNDVITHTLSQQQQQDPSTPRPPISLLALVESAKSLTNLTQICASTPLLQGLIFAAEDFALDLSITRTPSLTEFLFARSMIATAARAANLPSTIDLVCTAYKSTKGDGSPPAVLEEECRDGRRLGFNGKQCIHPSQVETAQAIFGPDPEEVKWAVRVCVADEKAARAGRGAWTLDGKMIDVPVAEKARAVVRKAEACGFDVGKLREEWGHQEPE

SEQ ID NO: 9 - protein, 322 aa, Aspergillus niger
MAARNTLRRALLYIPGSSQRFIDKSRTLTADCVAYDLEDSVTPHKKAEARSLVRRALDEPAPQGIRERAVRINSVDSGLALGDLTEVLKSPNLTTIVIPKVNTPSDLTFVNDVITHTLSQQQQDPSTPRPPISLLALVESAKSLTNLTQICASTPLLQGLIFAAEDFALDLSITRTPSLTEFLFARSMIATAARAANLPSTIDLVCTAYKSTKGDGSPPAVLEEECRDGRRLGFNGKQCIHPSQVETAQAIFGPDPEEVKWAVRVCVADEKAARAGRGAWTLDGKMIDVPVAEKARAVVRKAEACGFDVGKLREEWGHQEPE

SEQ ID NO: 10 - protein, 322 aa, Aspergillus terreus
MASRNTLRRALLYIPGSSQRFIDKSRTLTADCVAYDLEDSVTPHKKAEARSLVRRALDQPAPTGILERAVRINSVDSGLALADLTEVLQSPNLSTIVIPKVNSASDLTFVTDVITHTLSQLPPSQTTSRPPISLLALVESAKSLTNLSQICAASPLLQGLIFAAEDFALDLSLTRTPALTEFLFARSAIATAARAANLPSTIDLVCTTYKSDKADGSPPAVLQQECRDGKNLGFNGKQCIHPSQVSTVQQIFGPELEEVQWAVRVTIADDKAAKAGRGAWTLDGKMIDIPVAEKARAIVKKADACGFNVQELREKWQHQEPE

SEQ ID NO: 11 - protein, 286 aa, Aspergillus niger
MFRPRLPLSPHRFSHLRSHPAKTSDWSATQYLKFADERAIPTQDLLSHIPLQSPSHIVDLGCGPGNSTAMLSARYPSCPSISGIDSSPNMIARAKESSNNNTTFAVADVETYSPPPNQPVDLFFSNAVLHWLPRSTRLPTIRRLLLALPPGGVFAFQVPDTLNEPSHTSMREVARTGPWAEHLRGTLVERDELDSPGEIYDALVDCCESLRIWESVYYHSLGSWGEIVEWVKGTGLRPYLDGLRGEEERGEFLKVYEEKLREKYEKRADGRVLLRYPRLFAVAVRK

SEQ ID NO: 12 - protein, 264 aa, Aspergillus niger
MSDWSATQYLKFADERAIPTQDLLAHIPLQSPSHIVDLGCGPGNSTAMLSARYPSCPSISGIDSSPNMIARAKESSNNNTTFAVADVETYSPPTNHPVDLFFSNAVLHWLPRSTRLPTIRRLLLTLPPGGVFAFQVPDTLNEPSHTSMREVARTGPWAEHLRSTLVERDELESPGEIYDALVDCCESLRIWESVYYHSLGSWGEIVEWVKGTGLRPYLDGLRGEEERGEFLKVYEEKLREKYEKRADGRVLLRYPRLFAVAVRK

SEQ ID NO: 13 - protein, 265 aa, Aspergillus terreus
MSTAKPTTTKDWSASQYLKFADERTLPARELLARVPLEAPKTIVDLGCGPGNSTAVLAARYPGAHIVGLDSSPDMIQKAKSTLPEIDFRVADLRSYTPSSPTDLFFSNAVLQWLRRDERIEVVKRLLRTQSPGGVFAFQVPDNLMEPSHVLMRDVAARGPWAETLTHVHRDGIQSPQEIYDELIPLCATVSIFHTHYYHSLENHEAIVEWLKGTGLRPYVDPLGPAEKKAFIAEYLKRLEGAYPRSVDGRVLLRFPRLFVVAVRK

SEQ ID NO: 14 - protein, 493 aa, Ustilago maydis
MAPALNANPTTKRDELSAPSASHKLGMSSMASRAAGGGLKLTGLPDLSDSAGTLSDIFGTPQMREIWSDQNRVACYLEIEAALAIVQADLGIIPKNAAHEIVEHCRVQEIDWALYKQKTELIGYPVLGIVQQLVANCKDGLGEYCHWGATTQDITDTATVMQIRQSLTLVKQRLDSIVSSLEHLAEQHRNVPMAARSNLKQAVPITFGFKMARFLATFRRHQQRLVELEKRVYTLEFGGAAGNLSSLGDQGIATHDALAKMLDLAPAEIAWHTEHDRFAEVGTFLGLLTGTLAKLATDIKLMSQTEVGEVGEPFISNRGSSSTMPQKNNPISCVYIHACAANVRQGAAALLDAMQSDHERGTGPWEIIWVQLPLMMNWTSAALNNADFVLRGLQVFPDAMQHNLDLSKGLIVSEAVMMGLGNTLGRQYAHDAVYECCRTAFVQDRPLLDVLLENHEIASKLDRTELEKLCDPANYLGQCSQWIDRVLSRPSSA

SEQ ID NO: 15 - protein, 449 aa, Aspergillus niger
MLNSAVDSRIFRNLFGTEEIRDIFSDEAYIKCLIEVEIALARAEATFNVIPQESADVIAEKAKYENLNLSRMAADTENVGYPVLPLVWQLAEMVPQEHAKYIHWGATTQDIMDCASMVQIRRGLVVVRRNLHELDTALRALSEKYADTPMAGRTHLQHALPITFGYKCAVYLSGIQRHIQRLAEIELRCLLVQFGGAAGTLASLGSDNTGLQVRKQLARELGLHDPSITWHVARDHVAEVVNFLALVGGSLGKIALDIIIMSSNEVAEVAEPFVPFRGASSTMPQKRNPISSEVILASSKLLRSNASLALDAMVSDFERASGPWHLEWSCIPDSFVLCCGALHQANFIMRGLLVNTDVMSSNLNMTKGLIVAEAVMMGTAPKIGRQRAHDVVYEACTKAIEGNLPLIDILRQDESLVAQVGEEKLRSLCDPCQYLGCCRQMIENVIQYE

SEQ ID NO: 16 - protein, 477 aa, Aspergillus niger
MSASSFAQLCRITRPRISISPIVSRRYIGSVSAIDSGIFRTLFGTEEIRKVFDDEAYIKRCMDAEAALARAQSRCDVIPSQIGEMVTRKLRESKLDMERLRYETEIVGYPILPLVRQLSAICGDEAGKYVHWGATTQDIMDLASVLQMKEGLDIVEHHLKKVISTLRGLSVKYKDTPMAGRTHLQHALPVTFGYKCAVWLSGFQRHLERLEQLKDRCLLVQFGGAAGSMASLGTGDDGLRVRKALAEELGLTDPPITWHVARDGIAEITNFLALMGGSMGKLALDIIIMSSNELGEVSEPFVPHRGASSTMPQKRNPISSEVILAASKILRSNAGLVLDGMVADFERASGPWHLEWVAIPESFVIAVGALSQTQFALSGLCVHSQKMLENLHSTKGLIVAEAVMMGLAPHVGRQQAHDTVYEACRESIEANQSLLECLMKKTEVTSKMSEERLSQLYDPVNYLGASTRMVEDVLAVD

SEQ ID NO: 17 - protein, 443 aa, Ustilago maydis
MLHPIDTTIYRAGTSRGLYFLASDLPAEPSERDAALISIMGSGHPLQIDGMGGGNSLTSKVAIVSASTQRSEFDVDYLFCQVGITERFVDTAPNCGNLMSGVAAFAIERGLVQPHPSDTTCLVRIFNLNSRQASELVIPVYNGRVHYDDIDDMHMQRPSARVGLRFLDTVGSCTGKLLPTGNASDWIDGLKVSIIDSAVPVVFIRQHDVGITGSEAPATLNANTALLDRLERVRLEAGRRMGLGDVSGSVVPKLSLIGPGTETTTFTARYFTPKACHNAHAVTGAICTAGAAYIDGSVVCEILSSRASACSASQRRISIEHPSGVLEVGLVPPENAAQSLVDVAVVERSVALIAHARVYYTTPDRRRSYDSPLTSPSTPADTHNLFDAAYRPVIQPSDTDVEAPHMLALENKEQCVSRCDTALHHIVASYGASDAHASDRSLS

SEQ ID NO: 18 - protein, 395 aa, Aspergillus niger
MPIQRIMLRQLRHTLPSGSRSLSTKKQHHLPAAYYRGGTSRAIFFKQDDLPADKAKWDPIFRGVLGSPDPYGRQLDGLGGGISSLSKICVVGKPTHPSADIDYTFVSLGVKTPDVDYSSNCGNMISAVGPFAVDSGLVVPGLTSASVRIHNTNTGKIVHSSFPVVDGEAAASGEFAIDGVSGTAAPVQLDFVDPAGSRTGKLLPTGQVRDVFDGVEATCIDVANPCVFVRAEDLEVEGNLTPEEITAHPGLLDRLDSIRRQAGVKMGLADTREAVPGSVPKICLVSQPGTDTRAVEQKQTKEKVDLLVRALSVGQPHKAVPITVALAVASAARMSGSTVSQVVGEKRVDEAGITLGHASGNLLVGATFDEEGILRFATVFRTARRLFEGRIFWKG

SEQ ID NO: 19 - protein, 381 aa, Aspergillus niger
MFKYTYRNRVASSARRYLSKQHSIPAAYYRGGTSRAVMFNQAHLPPRSEWDAIFRSVIGSPDPYGRQLDGLGGGISSLSKVCVVGKSTHPDADVDYTFVSLGVKNSDVDYSSNCGNMISAIGPFALDQKLVSSQTPESATVRIHNTNTGKIITASFPVVDGEAASSGNFAIDGVAGTAARIQLDFVNPAGSVTGKMLPTGQTRDEFDGVPATCIDVANPCVFVPASSLGVRGDLTPDDIAAHPDLLQRLDSIRRQAGVKMGIASTTGAVPGSIPKVCMVSPPQPSKGKDPVDLLVRAISVGQPHKAVPITVALAVSAAARVTGSTVEDATNQDRVSDAGLTIGHASGNLLVGAQFENDQLTAATVFRTARRLFEGQIYWKS

SEQ ID NO: 20 - protein, 265 aa, Aspergillus niger
MPKSSQYSLPATYYRGGTSKALFFREDVLPDPGPQRDRLLKRAMGSPEPLQLDGMGGSKAVTSKIAIVRPSTRSDADIDFTFAQVGVARDFIHYGANCGNISAAVGPFAIEEGLVQFRPGRSVDTTVKTQEVRIYNTGTGKLLSAHFPVSGSGAFEPEGTHEIAGDPGKGSPVLLDYRFTIGAELSRGLLPTGNASDMITVAGKEFEITICDIANLCVFANARDFNITGHETAADLTANLDWLAKTQELLGKAAVLAGMSENWKA

SEQ ID NO: 21 - protein, 421 aa, Aspergillus niger
MTQTYSVTRAEPFTVLPITTKYRSNESVRKSLPAVWMRAGTSKGLFLHRRHLPASKTLWEPILLSAMGSSKGSSRQIDGVGGASSTTSKVAIVERSNRPGVDVEYTFVQVAPDQPRIDVTGNCGNIASGVGPFALDEGLVNIPEGEKEVNIKILNTNTGQHIFETVQVATDGSFREDGDYAIPGVEGTASPIRVAFLKPCGSMTGQMFPSGMHQEMLTVQSRGFGTLAVRVSLVDAANPFVFVDAASLPVEASSSIADAADPVFLGLIEDIRRHGAVRFGLAENVQAAGQVRGTPKIAILSPATGDVDGVDIEVKAFSMGKPHASLQLTGAVCLGAATIIHGTIAWDLAHAKEGKEMPKHGMSLGDHQIAGAVPVGIRHPAGVIHTETVLGMDRHGAIDVDRVAVYRTARRLFEGRVFYRP

SEQ ID NO: 22 - DNA, 4151 bp, Aspergillus niger
  CDS (1501)..(2111)
  CDS (2177)..(2648)
cgtccacttgactgtactcaagtcaacgaccagaaaggcgtcaaaaattcaagtaattcagcaagaaagacgtctacttgatatcaacatatcaacttaagaaagaagaaagagagtgtgtgtgcgtgtgtgcaggaaacaagccgacgaaactgattgtgtctgatcggaaggccaggcaggcaataatgttagatgtcaagcccaaacaggcaaaaatcaacgcgaaggggctcatacgtcttccgtttacactatctattcaacaagtttaccataccattgaaagtcattaaatataggggaaagttgaacaacgatgctgcgggtgccggactatgggacatgggaatgaaccagaaggtggggtacccatggattatgtccacctgctgcggtcttcaagcgaggtgcagggggctgctggtacgaggcagtttgtactggcagtctaatcttggcaagaatcatcggacagccagccgcgtctgacacctatcaagtggtttgggcagttaagtttacggagaatctgattatcctaacgcaaaccctttgcgatcgatacatttattacatgattatattaggggcatatatactctatgtccatatattttggatgatactctctgtaatgccgattcttagcggggtctacctactaccatagacacaaggattagcttatttcattacttagtcgagatgcgagggaatcccggagtttctcgacagaggaattctcgactcttctagatcgcctcgacaagaacaagaatgtaggcctacgggaaatttatggcgcatctgagcattgctataggactgttatttgacatgaagctgcattccgctaccacgcggctccggtaagggtaatataagtgctgcttattttcggaccctgatagccttcaagcatcactggtctagtgtacccagcgccggcgacgatgagtggatatattcgctgtggcagttaaaacggtgcagtatagcctacctaaaatgtacaaggcatcaacacctagtagtgccaaaaaaatcacgcttttatttcaaaagagtacgcctatctttagtctttccgctgtcaccgacaactactccgtagttcaataagaagtagaacatcaattatcagaaactctttcctgacggggtttctatctatttactaccgaatagtacttttaatatcttgaaacctgctgaagtcagtactactgtgccatagagaaaacaggaaacccctccacgctcggcgtcatttctcccagaccgagagaatgcggcggctaaatgacggcgccgaagcgaccccataaaggctactcggaacatagcctctggatcccggtctcggaaatgcccagcgacccgaggtacaaaaccccagcacttccgagacaacgccatgttaagctcgcctcttcacttcttccacgatcactcgaaccacactgaagcattatttcactctcaattaaaataaccatgtccctcccctcaataacccgcagttccacacgaaccctcctccgcccacaaaccgtcacaccccaactcacccgcgcattctccatccgcccagcactccgcaccgacacctccgcatccactattgcaacatccttcctcacgcgcttccaatccctaggcccacaaacccgctcccaaatcctcgatgctaatcaactccgacttctctcactaacactcaatcgaccctcactattccccaactccccatctctctccaacaccccaacctccctgccgaccggcacgcccttacccgccggataccacctcgtgtacttcacccccgcattcttggaaaatgagctaggcgcggacggcaccgacacctcatataaccctgcgtcgccgttcacgcgtcgcatgtgggccggcggggaggtgcattggccgaggggaaaggacggcaagccgaattacttaagggtagggcaggaggtgcaggagacgacgagggtgcttagtgcggagccgaaggtcgtgaggaagacaggggaggagatgattgttgtgggtgtagagaaggagtttaggaatgaggatggggtggcggttttggataggaggtgagctgatctgctatctatttgttttgtgagtttggggatagtgctgatgagactatatgtaggaactgggtctttcgcaaagctcttacctcgccgtcgcctacgagttcatctacacccccggcgacgaaggcatttaatggaccagctagttcgtctacggagacgagtgaaaatgtgcacacgcgcacattgcgccaaacggcagtgacattgttccggttctccgcgttgacgttcaatccgcacaagatccattactcgacaccgtgggcgagagatgtcgagggtcataaggatattgttgtgcatggaccgttgaatctcatttcgattttgcatctgtggcgcgatacgaggaagaatggaagtggggaggaggtggttcttccggagaagatctcgtacagggcgacgagtccgctgtatgcggaggaggagtatcggattgtgttggaagatggagaggatgggatcgggagggtgcagattgttgcgccaggggaggtggtggctatgaaggcggagattcagtagaaatcgtgtagttagtaggagtgggttgtagatattgtctgtttctagctgggagggatacatgtatggggtgctacacaagagtactaaatgacataccctgagatagaaatagtataggagttatctactgtatagtactacccttttgaacaagtaccgaatcttcaattctatataacttatctgctccacttcattcttaaagtatggttcggacttatcttcggagataaccactccacccccatccttatcgccatcacggcagccttccattccacttcaatccgacactcaactcaacttcacatccactatttatctatcgaccacaactaccccaccctccacacatctcccctgatactcggtacatactagacccactatatactccactgcccaacgacacagaccgaacaagaacagacatggaaaagaaacgcacccgcgttcaactctcctgcactgcctgccgagcccgcaagtaagcacgcggcaaccccgcccctctccctatctcacattcctccttctacctccaatcactggcgcctactactccatacgccactcaatctgatgataataacccatgcattaggctaaaatgctgtcgtacccacccctgcacaaactgcctgaagcgcaacgaagccggcacctgcaccttcgtcgggcgcggtccgcgcggcaagatttcgagtaatggacgaaccagcccggcgcacgttcaggatcgattacaacacttggagaatttgattttgtcgtttacgcagcagcagcaacagcaacagcaggagaagccggatagtgtgggcgaacaccaacaggttattaataatggtggtcagatcacgccggcatcgtcggtgccaccatcattatcatttggggacgtgcagcaggcacagaaggagggggaatcggaaactccgcctcctgatcccgggaggttggtcgttagggagaccggaatgaggtatattgatggagcgcattggactgcgattctcgaggaggtaagagcagtcttttcgagtaattggggagttagattgggtgggggctgatgacgtgcagattagcggggttaaggagtatctaagggataacgaggagatgggattgtcggacgaggaaggggaagatgaggagatggtgaggccgtcgaatgcgccaacgctattacttgggttgcaccaggaaatgactatggacgagttgttggacgggttgccggctcggccggtcgtggatcgggtcgtggctatgtttgtcagccttaatgagccgacgacaggtaggtgtcgctgttatatcgatccttaataggtggtgctgatagggttagtgatggtgcactttcctactttccagaaacaggtatgctagctcaatctagtgggaaatatgtagaggatgctgctgacgtgcgcagtataatcaattctggtcaagaccaaaggaggcttccatttcttggctggcact

SEQ ID NO: 23 - protein, 361 aa, Aspergillus niger; identical to SEQ ID NO: 6

SEQ ID NO: 24 - DNA, 3155 bp, Aspergillus terreus
  CDS (1001)..(1614)
  CDS (1678)..(2155)
tggctgggcaaatgtttgacgaaaatcgagaccgtcagatgatcctggctggtatgtgcctgtgcatgctaaactgtattcagccttggagataacatgctaagtaggatgtgattaaaattgcctcgtcctcgcatgtcaggcatagttatcgattgtgtcgtgcaagtaaagtagttcttggttgggacgatccgacgatcacaaacgccttatcacggagaagcaaggaggccatattgtgatgcgccacactaagcaggaagatagtaaaacaaggtatggcccgccacatgccgaagttggctcagttgagtggtcattaagatatcgccgtcgagatagtacgatgccccttctggccgtcaatcacgggtgcgctgtttcttcgtcggatgcatagcctgtcttctgagattctctgttgaagcctcgcttttaagggtgtctgatggacagacgagactttggtcctctgtcacaatgcatctggggggtctgacgatgtgacagtcctgatgcactcgaccagaacggaccacaggtgatgtaatgcgaagaagctcatggaaatggctcagggtggtcatctggcctcattctcctctgcagcagtccatgatagacaataaatgatgtgttgatatgcgatcacacttataatagtggcccagcatacagccgacttgaaagaagccgaagaagccgcatcggctacctgcagtcacagcgttgctcaacagggcttcgtaaggtcgcgactgtcggagaaatatctcgagaaataatgactcacgatgctgacgtgaccagtttaacatcctaagatgcgtgaagaagagttggttgcgacgagaggatgtcccggaaaggttagcacctcggctacttgggatctccccgttctccactcgtcgtacttcctgccctcactactgctataaattctcccattgaacctcatcggggtgttgatggttgtcaaaatcatctcggcataatgtcgatccatacatccgctcgttgggccatgcgatctgtccctccgctgacgcagggatgcgctgcacttcgccgcttttccgtccagcattcatgccgatcagcacctgaagctaccgctccctccgttgcagcttccttcctttcgcgattccaatctatgggaccacagactcgctcgcaggtactcgatgccaaccagctacagcttctatctctcaccttgaaccgaccctctctttacccgaactctccatcgctgtcgaatgcctctggtgtcgtgccgacaggtacgcccttgccccccgcctaccatctagtctacttcacccctgcattcctggagggtgagctgggtgccgacggaaccgatgtctcttataacccagagccgcccttcacgaggcgcatgtgggccggcggtgaagttcaatggcctcgaggggcagacggaaagcccaacccattgcgtgtcgggcaggaggttcaggaaaccacgcgggtgctcagtgcggagcctaagatcattcgtaagactggagacgaaatgattgtcgtgagtgtagagaaagagttccgtaatgaacacggcgtggctgttatcgatcgtcggtaggttttacgcatacctcatgtacgtcaagttacattgtacggctaatcaattatggtcagaaactgggttttccgcaaagccttggctttggcatcatcaccggtttcagcttctccaatctctgttcacttacccgcattgcccgcatcttgctctacctccaccgtgggaaagactcacactcgcactctcaggcaaacagccgtcactctcttccgcttctcagccttaactttcaatccccacaaaattcattactccactccgtgggctagggatgtggaaggccacaaggatattgtcgttcacggccccctaaatctgatctcgattctggatttgtggagagatacccgggcggatagcgccaccgactcatccttattgctcccagagagtatctcttatcgcgccaccagcccgctgtatgccgaagaaacgtatcggatcgtgcttgatgaggagcagggtgacggtgtgagccgagtacagatcttcacgccggatgagaaggtggccatgaaggctgagatcagatgaaccaatagacataactcgacgcttggattttctgtatatatggtcagacgacacgaaatacatcgttttcctcggctcgacttacagactagacttcagctgctgccagatgctggccgaggggctctgagcttaagttcttatacttcatgtcgagtacgtcttgtttttcatttggaccagacactaactccagatatgggtggaaatatactaaccgatgctattcttgcctccgccccaataacatttctctggataggaaatggaccttaaaaggaagatcagtctgtcggtgcttttaggactgggttccccgtatgtcgatgccttgaattttgagctaaaacgtttttggtaaaacttgatgttggatcacgaagtactacatcaatagaccctttcagttcactatatatcttcaggagctagcaagggttgttggctcgatacctgaagagttacggactacactgtgtttctttccctggatggacgcgaccatcagttgatatgagacagtgcttgattatcttacttttcctgattttttcgactgtccctgtgtatttaggagccaatgcctaggtttcgtgtcattcatagatataggttttgtgtggtaatgaatgattgcccctgttataggacgtgtgtgaggggaatatatatcacacgagaatctttgggacaccgaagagttacaaatctaattatgctacctagtagctatagatctagtctagtaatgagtgcttactttgaagacctacatggcgtagtccagtctgatactgtgtgggagacttcgtccggacttagtagcggagataatcaacccagaccgaagtctcgtatatgaatctcacctgatctcaccctttgtcttttctcccaatcccgcctccttcaagacatatcataacagccgaagcgcagactgaaaatggcagacacgaccagtggcgctgtactttctcccaaagaaaagaagagg

SEQ ID NO: 25 - protein, 364 aa, Aspergillus terreus; identical to SEQ ID NO: 7

SEQ ID NO: 26 - DNA, 4254 bp, Aspergillus niger
  CDS (1501)..(2754)
acagggcagcggacttcatggactacggcaggctgcgccggacattgggacgtgttcatgcgacacttgattcatatcgacagcgggcaatatgattcgctaatatacccttcacggccagtcctcagtttggcctagatttacaattccgtccgcactaaagaatgcagaccgagtattgacttgggcatcagttctgctcaggtcatagcacaaatgcttctgatcggagaatttcggatgtatccgaaacatctgcttgcggctgcacaccgacatgaaaaaggcacgtctcattcatcggaatattccccgtctcaaagttggtgacgtgaacggcacattaaccccaccaatcagacgccagggaggcctgatgctagcccgatgatcgtcaagcgagttccctggacgatgccgtcctccccgatggaacagccattatccatctgctggatgggaatactagcccgttgaaccgagctacttcaggaacagatgttcaagtgtgaccttcccgtctttaagtagtatagcttcacaattgggggttaaggctgcttgtgtcccttgtaagtgaccgacatcagcaatggccgttatgacgaccctccggtatttggtcgcatacgaggtgcagtagtacagcatattagaccaaaagcctccagggtgcttgcattgggatgaacatcgtccaggatcacctccggcggtatccagcaggtgttcagccgaatagccccgtggctgtatttggcagggagtatccttgtcggtttgcatataggtagctgtctagaacttgtgagttcgagctgcgcagttatatgggtgatcgttttccaagtggcatgctagcgacgtggctggaataagctatggtcaccaggcctcatagcacattgctccttcgtaatgcggcaattcaattcctatataacctttctaaagccctcgctacgatcagaaataagcaggccgtgattgaattctggtagtagaccttatgcgaccgcgcgaaattagtaaccgaatcattgatggattgactgcgagatggagattccagtatcattcctacaaccatgctcaagctgggaaaagctgtgaatgaacaattagcagaagataggccgtgatcaagccttgagatgcaatgaatagcaaaaatgtttcaatacctgctatcacaatctttgcagacagattgttactagggtggaaggatatctagttctttgggaacaacacactttgcctgatacatatcttctggagatttcattgttcttctggaaaatgatcagggcaggactttcatcctcttatagtacatcatctcccaataaactaatggtgggaccgaggccagcccggggcatataaccgaccccagagagcccgcgaccccacggtcggcgacgttctccggtcgacgatggcctcaaaaaccggggtcatcccccacgaaaatatccccaattcacaaccagcaccatgcctaacacccgtccccttgtccgtgcggcatgccataatctctccggcatgcgccatgcttctactagcgccacgaaaaaggctggccccctcgccggcatcactgtcgtcagtctggaacaagccatagccgctcccttctgtacccgccaactagccgacctaggagcccgagtcatcaaagtcgaacgacctggcgtcggagactttgctcgcaattatgacacccgcgttaacggcctagcctcccacttcgtctggaccaaccggtctaaagagagtctcgccttggacctcaaaaagccgtccgatcacagcgtgctcatgcgcctgctcggccgcgccgatgtcctcgtccagaacctcgctcccggcgccagtgctcgactgggtttatcctacgatgatctcaaagcggctcatccatccttgattgtgtgcaacatctccgggtatggtcctgacggaccgtaccgcgataagaaggcctacgatctgttgatccagagcgaggctggcatgctctccgtcacggggacgggaaaagagcccgccaaggtgggcatctccatcgctgatatttccgctggtagctatgcctactccaatatcctggcggcgttgtatcagcgggagagggatccctcgaagcgggggtgtaacattgatatctccatgttggagagcatggttgagtggatgggcttccctatgtattatacttatgagaatgccccgggcccgacaccagcgggtgcttcgcatgcggctatctatccttatggcccgtttgagacgggagatggaacggtgatgttggggatccagaatgagcgtgagtgggctaagttctgtgacatcgtcttgggtcaacccagtcttgctacgaatgagcggtttgtgaataactcgctgcgctcgcagaaccgtgatgagttgaagaagataatctgtgacgtcttctcgtcgctttcggcggagcaggtgattgctcgactggatgcagcggcgattgctaatgccagcgtcaatgatatgcaaggcgtctggaaccacccacagctcaaggctcggcagcgatggacagatgttaagacgcccgcaggaagtgtgccggctctgctacctcctggaatgaccatgggggatgaggatacttatggggcgcgcatggacgctgtccctgatgtgggtgagcataacaaggctattctggccgagttggggctcgacgagggtacggagaaatagctgcagttgaattaatgacatgtacagttgagctagtggacttggctatccttgcgagtattggaacttttaggccctttgtaaataactcagtgcgatggattcacctcgggcaattctactgtccactcacgaggttgaagatacctgcatgtcaaaggatgttcagacgtagaactagtcgaccacaatatggatcttacagtttaatccaattcaggcaacctacccctgctgcccctaatatcaccccgcgacggtatccagcgtaaagtgaatatcggcgcaatatacccatcgccgaagcaagtggatcgggaaaacaggcaaaaagccgacatgcccgccaagaccgaggcagcataaagccgctttatcctcgactacggctacttgcattctgcctggccacctctgaactccactgtggacgatctctttcattggtaattggagctaattcgaggatcatgtccagtcaggagtcatcgggccaccgacaggtaagaaccagggccaagcaggcttgtctccactgcaataagcggcgaatccgctgcaatgtgctacagatgcgcccatgccagaattgtctggcattgaatgtaccctgtgagataggcgtttcaaagcgaggaaagtatgttttcacggtttcgtcattatggtagtttggcgtagactgattcaatggcttaggtatccccgtaagaagagtgctcggcaacaaaccgacggcaactcggtccaattgccggcatcatctgcgaagggagggaaccattcattcaccgtgtcagcaggtgataaatccgacgcaaaagagtcgcatgttcacccgataccaggggatgctgcgagtgcgcatccaacagtgttctttggtgaatcgagtccactcactgtagtgattgacgaagggcgccggtcgcctgaaaagggaactaatgagatgcatatgactcgctttcattatgccattcctgagaaacttgatgccttcaacacccgtgatgaggctttccgagcacacaagatcaagcaggaaggccagctgagagctgatggggccttctcgtacccgccgccagagacatgcgaaactcttctgcgggcgtactttgactggtttcacccctgtttcccaatccttgattgtgctgcggtgtatgagagctatgtgcaggggagcatgtcgcccctcttactccaggcgatactgttcataggcgtcagcctttgcacggatgaggtgtttgcccggacggagttttctgttcgatactgggccaagtttctcttttacagccgagcaaaggcaatctacgatgctgaatgggagtctaacaagacggtcaagattcaagcgctgtttttgttgagcttctggcgtggaggaccatctgaggagcgggacattcgattctggcttggcattgccattgacctggcacaaaagcgcggcatgcatttgatgtatgtattcttttgtcttaccct

SEQ ID NO: 27 - protein, 417 aa, Aspergillus niger; identical to SEQ ID NO: 2

SEQ ID NO: 28 - DNA, 3242 bp, Aspergillus terreus
tcctctaacggggtggtccgagcgaggagaatcatcttcgacgcaacctgtgcgcaagtgatccagatcttctgtccagttactgaatacgcgtcctgggacgcattcttccttgcaagcgtcttgagcttcagagtctcgagtccagtgttgggttcagtcacgccgaagcatgtccgccacgtgccgttgatgatcttggggattgtctcctcccgttgctctttcgttccaaacttggcgagcggttgggtggcatacacgttcgcgtggatggactgggcgccagcaatgccggcccctgattgcgtgatagtctgcatcatcatggtggcttcggagatgcctgtatagacggttaggatgtacatattgtgtaggcttggccatatccgagaagagctcacctagtcctgcacctccgagctcctctggaagagcaattccgagccatccgtccttcgctagcgctgcatggaattccttagggtcttgctcggtctggtcgtgctcctgccagtatgtgttggggaatttggaacaaatcgccgaaattgcctcgcgaacggtcaactgctcctcagtgaagccggtcagctccatgagtggtcgctttgtcgtggtggaaaactgtgatgcgcgagactttgatacggcgagccatgttgggccggatgtgggtgcaacacgccggcgaacatgggccactgccggactcagccgcagatatagattccgcttggtatatgcaggggacatgtggagcaattggattttctgggatgtgctgacgaacgcaaccagaatagaggcagatatgcgtcacttatatcgtacgattgtagcggtggggagctcttgttgcatatagccgtccatatacccgtcgagtaaccgtgcagcaccgaggtccatctgatgtccagctctgccgtcctatgtcaccgataaatactctgcacgccgttgcattttgcaaccattctcacaataaacagcaatgtcgctctcaagacccctagcgcgagcgtgggcccagacgctggctcccagcactcgcagacacacctccacccaagccggcaagaccgggcccctcactgggattacagtcgtcagtctcgaacaagctatcgctgcaccgttctgtacgcggcagttggcagatctgggcgctcgagtcatcaaagttgaacgtcctggtgttggcgatttcgcgcgcaactatgatacccgggtcaatgggctagcatctcatttcgtctggacaaaccgttccaaggagagcctcgcattggatgtcaagaagcctcgcgatcaccaggtattgatgcgccttttgagcaaggccgatgtactggtgcagaacttggctcccggagcgagcgctcggttgggcctgtcgcacgaggatctcaaagctaccaacccatcactcatcgtgtgcaatatctccggctatggtcctgatggcccctatcgcgataagaaggcctatgatcttttgatccagagtgaggcgggtatgctttccgtgacaggaacggggaaggaacccgccaaagttggcatctccatcgccgatatctccgccggatgctatgcgtattcgaacatccttgccgcgctgatccaacgagacaaggatcccaaacgacgcggttgcaatatcgatatctccatgctggagagtatggtggaatggatgggatttccgatgtactacacctacgccaacgcccctggtccaacacccacaggggcatcccatgcagcgatctacccgtatgggcctttcgagacgggagatggatcagtgatgctcgggattcagaacgaaagagagtggaccaacttctgcgacaaggtccttgggaaacctgagcttgcaacggactcgcggttcgccaacaattccttgcgctcacagaatcgcgaagagctgaaaatcatcatctgcgaggtgttttcttccctcacagccgatcaagtgattgctcgcctggatggagcttcaattgccaatgctagtgtcaacgacatgcagggtgtttggaaacaccctcaactcaaagctcggggtcgctggacggagatcgagacgccagctggtacggtccctgctctcttcccgccaggcatggatgcgtcagcgaattttgctgcccgtatggatgctgttcccgctgttggggaacacaatgagtcgattctggctgagctgggtatgaaggagtcaaaataggacataaatggtgaccttatgtcggttcaggtgatatgggttatagagatcatctctcgctatttctgaacttagaccttataaaacaagtatgcttgatcattagattattgcattaagatagtatccctatgcttgccacaggctgaaacagccagcaagaacgctcgaaacagattatagactaggctcacattaagcccacgagaaggacaaggggggataaatagcagcagtatcaagagaccataaacgagcctgtacctctgtcccatggtcacaagataggacacttgttgacggcatctgcagcgcagtcgagtccagccttacactggtatggagagataccctgttggccgcatgtggtgaactggaagccaggcatcattagtcctattcatctaacagacacagacaggcatacctttggaagacagtcgtaggctttgttggtgaccacgacgcagaatagccagcggacggccttcactcactccgaactggatggctagccaccccatggcacggaggaaattctcccagggccccgtcatggtgacgaggtcagtattgaggttgatttcaacaccatccggaccgaagacatttgctgataacacacttagtgacattcaggtggaaggggtgggatccaatacctccattctcgtgtgccaatatcgtcccctggtagactccgccggtgtacagatcaagctgactcctgttgtccgggatttcagtgtatgacacctccccatatggagtagagaccgcattgatgggttcgttgacgactgggcctctcttgacaggtgaagctgtcaccaaggagcaagaaagggcgagaaccccggtgacccaggagtagaagggagccatcctgccagtatgagggtcaattttttcaatataaaatgctgaagggcgcaaggtacctgctataacagggtctgatggcttcagtgatggttgttgcggatgatgttcagca

SEQ ID NO: 29 - DNA, 3150 bp, Aspergillus niger
  CDS (1001)..(1040)
  CDS (1161)..(1380)
  CDS (1442)..(2147)
tgcgggtagtgggatcggaggactcgaagacccaagtagagtcgccggaggaagtgttgacttcgttccaccaacggagaccgaccagtcggcgaccggcgatgtttttgaggtagtagaaatcggcggaaaggatgaggagggtgatgatgaagacgaggacgctggttgcagtggttagcttggttgtttgctcggatctagatagggtagctctgggaggttccgggtttggagattaagggagctagaatcttgaagttgagtttgaaaggtgttttacgcacaagttcttgataaagagcacgccgaagaggtacatcagtagggcgccgatgcgaaagcccaggaagaacaggagagtaatcggatgggcactgaggcgccagttcagttcgccctgctgcggctggagcggttgttgttccatgatgacaaaaaaggggcaggatcaagtcaagaaatatcctctggaaacagtccaatgcacatgagatagacggcagtcaagcagcctcctgacgagtccagatcatgcgaggcgggattgcgttgatgctgcgtgtctccagccaggggcggtggggcgcggcagaatgtggagcggcggacggttacttgacactctttcatcttatttctccgactcccatctgtttcatgcgcgatcggcactcgggctctttcatattgctcagcttggtgtacaagaaagacaaaggcagtggttgtcacaggtgaataatgcaagtgccaatggaacgaactaaatacgggccagtcgcgacacctgccggatgaggtcatcggccggttcctgactggagaagcctttatgcgcaaaccgaggatctcttaaagttgcgggtcaatccgcaaccgctgcagcagcttcatccgataatctccattctttcaacccaacaggagacattgcagttcagtgtgatcccaaactcattaccatcgcctcaactgaacactatctctctcatcgaccatggccgccagaaacacactccgtcgcgcccttctctacagtacgtcactgcccccttctcttcccaacccatagctctccccgcatttccgcactcatcccacaccccaacatgctatccgactataccaattaccccctaactaacccccaatcccagtcccgggctcctcccaacgcttcatcgataaatcccgcacactaaccgccgactgcgtggcctacgatctcgaagacagcgtaactccgcacaagaaagcggaagctcggtccctggtgcggagagcactcgacgagcccgcaccgcagggaatccgcgaacgagccgtacgaatcaactccgtggacagcggcctcgccctaggcgatctcaccgaagtggtgagtaccattatcatccctcacttttctcctccattcaactcactaaatccggtaatagctcaaatcccccaatctcacaacaatcgtgatccccaaagtcaacaccccctcggacctcactttcgtgaacgatgtcatcacgcacactctctcccaacaacaacaggatccttccaccccgagacctccaatctccctcctcgctctagtcgaatccgccaaatccctcacaaacctcactcaaatctgcgcctccacgcccctcctgcagggcctcattttcgcggccgaagacttcgcactcgacctcagcatcacccgtaccccgtcattaactgagttcctcttcgcaagatctatgattgctacggctgctcgcgctgcgaacctcccctctactattgatttggtctgtacagcgtacaaatctaccaagggggacgggtccccgcctgcggtgctggaggaggaatgtcgcgatgggagacggctagggttcaatgggaagcagtgtattcatccgtcgcaggtggagacggcgcaggcgatctttggaccggatccggaagaagttaagtgggctgtgagggtgtgtgtggcggatgagaaggctgcgagagcgggacggggtgcgtggacgcttgatgggaaaatgattgatgtgccggtggcggagaaggccagggcggtggttaggaaggcggaggcgtgtggatttgatgttgggaagttgagggaggagtgggggcatcaggaaccggagtgagcatgcttgtactaggtggtgtttgtgtcttgagtgagaggagttatatatacaaaaattcagtcaagccagttgacaaattaggagtaactatttatggtacttgttggatgaggggaaggtagaaccgaaatgagatcaagaaaagatttgagtagatagtctatcgatcacctcttatactccgggactatcacttccctacaagaattcacataaaacccagtagtctcccaaagcgtatgctaggctgagttggaggtaatgttgaattcgggagatcgagcatcaagaaaggttttcttgagtgtttgaagaagatttgctgtttattattgctttgactccaggtcttcgcgcttcaacagctggatcttgcccatggtcaagatgggctggtccgcatccgccttgctgtttgcatcatcttccagactcttggctagtgatttatcgtagctggtggggtcaatccccaggattccaccaacatatccaccccgctcgccggggacactgaactcgcggaacaggtacttccattcatttaaccatgccttgacggccttgccgatcttgtccttgccattcttggaatgatggcccgtgcctgtgatcgcgtagactacgcgccggccttcgcgggcatgcttgagcaggatcttttccaggtattcaatggcctcctcgggatgcaagccatgcaggtcaacgtacagttcctccgctgcatcatccagaccagcgtctaagagatgtttgttacgttcttcgtaaagttgccgggctgcttcccgatgacacttgcgcatggcttcgttttcagcctgaccccgcagagacaaagcctttgcggctcttgcgtcattgcggttccacgcttgagcagcactaaccagacaattagcttcaagccttcggacttcaaaagtgtcaatttacctttgaaggaatttgttcctcaccgtaccatggcggatagcctccgtccggtatttga

SEQ ID NO: 30 - protein, 322 aa, Aspergillus niger; identical to SEQ ID NO: 9

SEQ ID NO: 31 - DNA, 2708 bp, Aspergillus terreus
  CDS (571)..(610)
  CDS (711)..(931)
  CDS (998)..(1705)
ggaggggttcctgttccatgatgcgaggacggaaagttagacaacgcgaaaagcagagagaggtccaggcggatgggagcaatcacgctcgcgcttcttgggagaatcaacacggggaaagtaagagctggatgcgatgatgcggccgatgaagctgcgtggctccatcccgggcggtaacgtctggcagaatggcccgcctactcagtcacctatttacagttctactctctactccggagtatagccaagtcaccattccaccgtatggacaaagatggacctcaatatgtgttatctgagctgcgacgggtaaatgcttgcagttattgtctagtagtgatgggtgggccagccaatatacccgacccatctgcatcatagcactgatggccggagaagcctttatgcagcaaaccgagggcatccttaaaacccgccagcttccataacttgccctcttgcattctccccgtcttcacttccaccagcacactggaaagtcattagtctgcgcagaacagagcatcaatttacttcattatatcgaaacggacggcccctcctacaatggcatccagaaacaccctgcgccgcgccctcctatacagtacgtcaacatacgttcttccccgcatctgcctcctatccgacctacatgatagagtcgcggcgcctacacaatgacaacccctgacacaaactcctagttccgggatcgtcgcagcgatttatcgacaagtcccgcaccctgaccgccgattgtgtcgcctacgatctggaggacagcgtgactccgcacaagaaagcggaagcccgctctttggtgcggagagcgctggaccagcccgcgccgactggcattctcgagcgcgcagttcgtatcaactccgtcgacagtggcctggcgctcgctgatctgacagaagtcgtacgtctactatcctcttctgagaaaccaggtagataatataagaacattggactgacagaaacgcagctccaatcccccaatctgtccacaatcgtgattcccaaagtcaactccgcatcagacctcaccttcgtcacggacgtcatcacgcacacgctctcacagctgcctccatcgcaaaccacgtcgcgcccgcccatctcgctcttggctcttgtcgaatcggccaaatccctcaccaatctgagccagatttgtgctgcatcaccccttctccagggcctgattttcgctgcagaggatttcgccctggatcttagtctcacgcggacgccggccctgacggaattccttttcgctcggtctgccattgccaccgccgctcgcgctgccaacctcccctcaaccatcgacttggtctgcacgacatacaagtccgacaaagctgacgggtctccgccggcggtgctgcagcaagaatgccgcgacggcaaaaatctgggattcaacggcaagcagtgcattcacccgtctcaggtatcgactgtgcagcagatctttggtccggagctggaggaagtgcaatgggcggtgcgggtaactattgcggatgacaaggccgctaaagcgggtcgcggtgcttggactctagatgggaagatgatcgacatcccagtcgctgagaaagctcgtgcgattgtgaaaaaggctgacgcctgtggcttcaacgtccaggagctgcgtgagaaatggcagcaccaagagcccgagtagatcttcagggacggcgatgtgccaaggaaccaaagtaaagctgtaagttctagaacattgaatatatacattccacagttagcctgcatatcgttgagagtatgcacagtaagagagaatacaatacaacaagtacgaatatagtgtgctgaatgagaagacaaacagattctagaggggaaaacttcagggatgctacgctcattgaaggaaaagggatctcgtgaaaatcgtaaagtggatgggggtcctggtagcaagaagttgatgtcattcgggctttgactccaagtcttcacgctttagcagctggatcttccccgctgctaacaggggttgattaccggcttcattgtctccgccgtcttctagagctttggccaggctcttgtcatagctggtgggatcgattcccaatatgccgccaacgtaaccaccgcgttcaccgggcacactaaactcgcggaataaatatttccactcgttcagccatgctttcactgccttgcctatcttgtctttgccattcttagaatggtggccagtaccggtgatggcatagacgacacgtcgcccctcacgggcgtgcttcaggaggatcttctccaagtactcaatggcttcttcggggtgcaacccatgcagatcaacatagagttcttctgatgaatcctctaatccagcattgagaagatgtttattgcgctcttcgtagagttggcgcgctgcctctctatgacatttgcgcatggcttcattctctgcctggccccggagagatagtgcctttgcagctctagcatcattccgattccatgcttgcgcagcgcttcaggaagactgtcagctctgtgttagtcagtataagatggcgcgcatacctctgaagaaatttgtttctcacggtgccatgacggatggcctccgtacggtacttgatgtattgttggtttgcacgctgcccggtctcgagccagggaatgttctggggaggcgggat

SEQ ID NO: 32 - protein, 323 aa, Aspergillus terreus
MASRNTLRRALLYIPGSSQRFIDKSRTLTADCVAYDLEDSVTPHKKAEARSLVRRALDQPAPTGILERAVRINSVDSGLALADLTEVQLQSPNLSTIVIPKVNSASDLTFVTDVITHTLSQLPPSQTTSRPPISLLALVESAKSLTNLSQICAASPLLQGLIFAAEDFALDLSLTRTPALTEFLFARSAIATAARAANLPSTIDLVCTTYKSDKADGSPPAVLQQECRDGKNLGFNGKQCIHPSQVSTVQQIFGPELEEVQWAVRVTIADDKAAKAGRGAWTLDGKMIDIPVAEKARAIVKKADACGFNVQELREKWQHQEPE

SEQ ID NO: 33 - DNA, 2861 bp, Aspergillus niger
  CDS (1001)..(1861)
cagggctatcgagtacggtacgacttgtacacgatgatatggtatgcaagcgaatacatcactggcagtaatctaaatatcgaatacttagcccccatagaagaaccgcagctgcgtttagtctattggaagactctagtgtctggtgaaaggacgattaagtccgaataactgcccagtaacatagagagtggcctatattggtcaaacgtctgaagaggggaattctatgcttgcggcctcatttgatgtcaagcttagcacggataaaagcgtgtttagtatgtgtatgctgtttcttcccctggtctaatttgaagtgctatgttcttcattctatctcttcatactcttagaaggttctaattatcctatcgtcctctcatctctagatctggactatataggcgtcaattgagtgacagtggcatggtgattattggcagtataaagatatttgtctatattataagcgactgatggcaacgcgcccacctgactatttcggtagacttgaattagcaggatactgtatcttacggttgatatttaattagtgcgagaattagcgatatgacaacgcggaatagctatccctggctgaagttctgcccttcaatcttcgaggtgtaatccagcggcaacatccgttgaacacgtgcggggtggaagtccccgacgaacttgtcgacgcgacgaaatctgtatgttttcagagtaacctcacgtatccgcgtcttccgggttgacagcataagatgatatcagtgtaatataataagtaagcaagtaagcagggctgacgaagattgttcctatcccgtgatactttaacagagaagccaatcatgtttccgccgaaaccggcactttcgaggtaccaccaccactataacatcatcccacttatatacctcacaacaatataaatactgaagttcctatacatcgtcaacactaacaacacatccatctacaaccaccagctgttaaacatcaaatgttccgtcctcgcctaccactctctcctcaccgcatctcccatcttctctcccaccccgccaaaatgtccgactggagcgcaacccaatacctcaaattcgccgacgagcgcgccatcccaacccaagatctcctagcacacatccccctgcaatctccctcccacatcgttgatcttggctgcggccccggaaactccaccgccatgctttccgcccgctacccatcctgcccgagcatctccggcatcgactcctccccaaacatgatcgcccgcgccaaagaatcatctaacaacaatacgaccttcgccgtggcggacgtggaaacctactctcccccaaccaaccaccccgtagatctcttcttctccaacgctgtcctgcactggcttccccgttctactcgtctccctactatccgcagactcctactaactcttcccccgggcggggtcttcgccttccaggtcccggataccttgaacgagccatcgcatacatctatgcgggaggtcgcgaggacggggccctgggcggaacatctacggagtacgttggtagagagggatgagttggagtcacccggggagatttatgatgcgttggtggactgttgtgagagtttgaggatttgggagtcggtgtattatcattcccttgggagttggggggagattgtggagtgggtgaaggggacggggttgaggccgtatttggatgggttgaggggagaggaggaacggggggagtttttgaaggtgtatgaggagaaattgagggagaagtatgagaaaagggctgatgggagggtattgttgaggtatcccaggttgtttgctgttgctgttcggaagtgattttcttctcttgtttatttacgagattgggtttggaggtgcagtgtataggtagaggacagaatggaggatgctctgatcatgtcatccaagcttccagtgtatatggcaggcatgcatgctggtataatcctaagtttatagctcgcatatggaatatatcgtcaggtccatgtaagccgtcacgcaggtacatagcttggcctagcaagcttatagctggactgaaccacctcaattgatcctgtgatacaaattaaaatgcatgactcaaacagtttcaccagaaatctcgccagcgctcgatcattccccggacgccatcaagttagaatgctgagattgaaagcgggacacgaacaaggaacgcagttacacagaaccacattaccacctggttcaatgccaattacataattgcaaaatggtacagatcgtcaatccatgcataatagcattgtctataccccagcttcatcgaaatagatcacttactgcagactccctccttcacagcatacccgacggccatcccgatcaaggggaccgaatgccccggaatcatcaacccacattccacgcccccttatattaccacaaatctccactacaatccccgcgttcaaggaacgccccttagctaacccaaacaagggcgcgtcaacaaaccgaccgccatacggcgtaacatgcctcattccgccctgaagaactgattccccaccaataccttactgcggaaatcatttacccggagtatccaggcacaatccaatcaagccatgcatgcacccacgcaggtgtacacaggcatgccttgaagatgccaacgcgttcgcttatttcctccttctctcccctcccttgaagaatcgaatataaaatccagcttgatatccacgacagattctctttttcatccatcagcaacaatcacagcagcagtctagcagccaatactttctcttccacgacaacaatcaaaatgcaattcaccacc

SEQ ID NO: 34 - protein, 286 aa, Aspergillus niger
MFRPRLPLSPHRISHLLSHPAKMSDWSATQYLKFADERAIPTQDLLAHIPLQSPSHIVDLGCGPGNSTAMLSARYPSCPSISGIDSSPNMIARAKESSNNNTTFAVADVETYSPPTNHPVDLFFSNAVLHWLPRSTRLPTIRRLLLTLPPGGVFAFQVPDTLNEPSHTSMREVARTGPWAEHLRSTLVERDELESPGEIYDALVDCCESLRIWESVYYHSLGSWGEIVEWVKGTGLRPYLDGLRGEEERGEFLKVYEEKLREKYEKRADGRVLLRYPRLFAVAVRK

SEQ ID NO: 35 - DNA, 2836 bp, Aspergillus terreus
  CDS (1009)..(1806)
gcggtaacatgaccgaagcagcgccatcgtcgccttccagaagaagggcatggacgtgtcgacgggcacagttggacctcttctacctggtattagatgtgcgctgacagtccaggggacggcggaggacacgcccgagggcggaccgggcgagctgtggatcagcgggccgaatgttgcgtccgggtatgtctgcgtcgctgatagtgacgcggtcaaagccaagtcgtttccgctgcctggatggtacaacacgggggatgtgtgcacaattgacgagaatgcgttcctcgctgttgtcagccgcacgaaggagcttatcaagtacgaaaggttccaggcgagtccggttgagctggatgcgtatcttaatcgaaatccgctggtgtggcgtgtgggaagtgagcgagttgccctggaatgcaactatgaagattttgaggactgagctcaagaagcgtgttacaggtatttgctcgttggggagggctcgaccaaaggctaggttgtaggctgtagcactacatctagagtatctcagtgtcgagacttagcacatacaatatcgtacgtattattcctgaacctgttcgatcaaatcctatggtctatgaaagcgaagggaatcctccgaatatcggcagtttcacaactagtcgcctccgtgagcaagaggtacgagataccaactaacccgtagaacggattggtagaacatgacaagtcatatgttggaaattatggcattaattagcataatcaactcttctcttcgcatagaatgagtcaagactccgatgttcggtgaagtaacaaatagatcactcccgcgatcacaacaccaaccccttgggtcatccggtatttattcagatgcaattcgtgtcatcaaaccaacacatcctcagctacatctcaatcactgaaatgctaactcctcctcaaccactttctgcccggctgatctggaagaacctctccttcaagaccctcacaactccccgcacaatgtccacagcaaagcccacaacaaccaaagactggagcgcatcgcaatacctcaaattcgcagatgaaagaacgctgcccgcccgcgaactgctcgctcgcgtcccgctcgaagcccccaagacaatcgtcgacctgggctgcggaccgggaaactcgaccgccgtgctcgcagcccggtacccgggcgcccacatcgtggggctggactcctcgcccgacatgatccaaaaggccaagtcgaccctgccggagatcgacttccgcgtcgcagacttgcggtcgtacacaccgtcgtcgccgacggatctgttcttttccaacgcggtgctgcagtggctccgcagagatgagcgcatcgaggttgtcaagcgcttgctgcggacgcagtcgccaggcggcgtgtttgcgttccaggtgccggataacttgatggagccgtcgcatgttctcatgagagatgttgcggcgcgcgggccgtgggcggagacgctgacgcatgtccacagagatggtatccagtcgccgcaggagatctacgacgagcttataccgctgtgtgcgacggtgagcatattccacacgcactactaccattctctggagaatcatgaggcgattgtcgagtggctcaaggggactggacttcggccgtatgttgaccctctgggtccggcggagaagaaggcgttcatcgcggagtacttgaagcgcttagagggtgcgtatccccggtctgtagatggccgtgttttgctacggtttccgagattgtttgttgtagctgttaggaagtagcattccatgtccatctatcatgttattgttcatagtcctgcgaacaccccatatccgatgcaatctgatccggttcccgaagtcgtcccgtggcggaaaagatgcgtaagaacaagacgttcagcatcagatgccgcctaagcggtagtggtagtgacggactaacgtaatatcctgctgagaccatggaattggcctacgacaaagaaagaggtcttcctgctatgtcggttgtttgtataagcctcctctttgtaacatatattgtctcatctggaacaggcatgccagacttcgtgcattacacgaaaattgtatgagctgtctagaataaaaccagttccagtccaagccgcgcaaagtacatgtcccacggcaatgaagtgccagaggcccagaacgtgcttagcaaacgcttggccctggtaaaatttcccattccaaaaccctgcatattgttcatgcgatcttgtacaaagcttcgttgatttggatcctctgtctcacaccccgcgctgaatatcggccataaaataaggatatttgctggtgatagcggccgaatgtgtgctacggcatcaaggatgttctcaatatctgccaaaacttttgtgctgtttttaggcagcatctgaactcggcggtgaagatgcaacaacgctgaatagacaaaggcgtggtgggtctcttgtagctcagtggcgagttcacctcgcgagcttctcacattgtcggatacagtgcggccaacgagagagtaaagctctgtttccaggatctgagcgtcccgatcgatatctcgaggtacttcattcccgagactcgcgtctgtatggcgttgcaaaatcaagtctgatagacgagcgagaatcggtatcagatccaatgaataaccacaaatatcgtccacatccctcgtgtcagtgccgaccatactcagtggcatggtctgagcgtcgtggacacagcctgcttgcagccctgacaaaccagccaacacatccattgtcatgaaccattttgccagaca

SEQ ID NO: 36 - protein, 265 aa, Aspergillus terreus; identical to SEQ ID NO: 13

SEQ ID NO: 37 - DNA, 3063 bp, Aspergillus niger
cgtccacttgactgtactcaagtcaacgaccagaaaggcgtcaaaaattcaagtaattcagcaagaaagacgtctacttgatatcaacatatcaacttaagaaagaagaaagagagtgtgtgtgcgtgtgtgcaggaaacaagccgacgaaactgattgtgtctgatcggaaggccaggcaggcaataatgttagatgtcaagcccaaacaggcaaaaatcaacgcgaaggggctcatacgtcttccgtttacactatctattcaacaagtttaccataccattgaaagtcattaaatataggggaaagttgaacaacgatgctgcgggtgccggactatgggacatgggaatgaaccagaaggtggggtacccatggattatgtccacctgctgcggtcttcaagcgaggtgcagggggctgctggtacgaggcagtttgtactggcagtctaatcttggcaagaatcatcggacagccagccgcgtctgacacctatcaagtggtttgggcagttaagtttacggagaatctgattatcctaacgcaaaccctttgcgatcgatacatttattacatgattatattaggggcatatatactctatgtccatatattttggatgatactctctgtaatgccgattcttagcggggtctacctactaccatagacacaaggattagcttatttcattacttagtcgagatgcgagggaatcccggagtttctcgacagaggaattctcgactcttctagatcgcctcgacaagaacaagaatgtaggcctacgggaaatttatggcgcatctgagcattgctataggactgttatttgacatgaagctgcattccgctaccacgcggctccggtaagggtaatataagtgctgcttattttcggaccctgatagccttcaagcatcactggtctagtgtacccagcgccggcgacgatgagtggatatattcgctgtggcagttaaaacggtgcagtatagcctacctaaaatgtacaaggcatcaacacctagtagtgccaaaaaaatcacgcttttatttcaaaagagtacgcctatctttagtctttccgctgtcaccgacaactactccgtagttcaataagaagtagaacatcaattatcagaaactctttcctgacggggtttctatctatttactaccgaatagtacttttaatatcttgaaacctgctgaagtcagtactactgtgccatagagaaaacaggaaacccctccacgctcggcgtcatttctcccagaccgagagaatgcggcggctaaatgacggcgccgaagcgaccccataaaggctactcggaacatagcctctggatcccggtctcggaaatgcccagcgacccgaggtacaaaaccccagcacttccgagacaacgccatgttaagctcgcctcttcacttcttccacgatcactcgaaccacactgaagcattatttcactctcaattaaaataaccaagccgctgctggaattgttgtgtgtagttaggctagatgacagtactaaaattagcggatctgttgggaatgataattgtagtacaacttcaacttcgctagaaggtccaaaggaataaacttacaggaacaatgatgggctttttcacaactggggcaaattgtctagcttaaacagcgctcttggttgctgttcaaccgttcctggtattatcggtcaccgggcctgccagcgaacagtgttaatataccgaatgagaagcttccaacaaacaaacgaagaagaattgaaaagaatgaaagactgctgcaaagccaggtctcagaagaaggaagaaaagcccaagggaagggaggggaaaaaaaccgaccttacgttaaagcaaggggaagatgagataacctatcgtaaagaaggccggacttcggaggttgccctgtggcacgtgtcccactcccaatcggtcagttacagaccctcaacagagcctaagggttatttagtgcacagaatatgagatccaggactatatagggacaccagttcactctgagatgtttgaaccaggcagatcgggcggtaagcagagaaagaggaacttgggagaggaggagagaaagagagctaacacgatacgtcggtccgatccacgggcctcctcccagacccctcattcctgccattggcctaaggccttcgcccgccttgcccctccttgggaaattgcctaaaagaaaatcataaaaaaaaaaaaagacccatcgatcgttgctgataaccgtcttttcccccaaaacaagtctcaccaccgaatctcactactctggactatttttgtgtttaaccaattgaggctcccaaattattagccttgttccactgaaccctgaaatcttctatcaacacaaaagtcgtcgcaaggaagatctacaacaatgtccgccgctaccatccctgctcctgccgccgagcaagactacaaggagacattgcttcccttgttgatgaagaataacgtcctgtcctttggctcctttatccttaagtccggccgtgaatctccgtacttcttcacctcttctctcctccacactgcgcctttgctccgtgccacctcggcagcctatgccagtgtcttgtctgccccgccattcgtaactgttgcggcggacggtactaccacacccaacttcgacattatctttggcccggcttataagggcattccggtgtgcgcttccgttctgaatgaattagcggtgcgagactctctctccgcgtctgctaagggaacctgggacaatgtcagctactccttcaaccgtaaggaggccaaggaccacggtgaaggaggaaacattgtcggtgctcctctgaagggaaagcgtgttgtcattgtcgacgatgttatcacagctggaaccgccatccgcgaggccgtgagcatcattcagaaggaaggcggtattgttaccggcattgttgtcctacttgatcgcgaggaaagagtcagcgacgctgagcctaagagcgctatcggcgttgcacagagggatcttgg

SEQ ID NO: 38 - DNA, 2794 bp, Aspergillus niger
atctccgtacttcttcacctcttctctcctccacactgcgcctttgctccgtgccacctcggcagcctatgccagtgtcttgtctgccccgccattcgtaactgttgcggcggacggtactaccacacccaacttcgacattatctttggcccggcttataagggcattccggtgtgcgcttccgttctgaatgaattagcggtgcgagactctctctccgcgtctgctaagggaacctgggacaatgtcagctactccttcaaccgtaaggaggccaaggaccacggtgaaggaggaaacattgtcggtgctcctctgaagggaaagcgtgttgtcattgtcgacgatgttatcacagctggaaccgccatccgcgaggccgtgagcatcattcagaaggaaggcggtattgttaccggcattgttgtcctacttgatcgcgaggaaagagtcagcgacgctgagcctaagagcgctatcggcgttgcacagagggatcttggtgaaaacatccccattcgcgcagtgattggtcttcacgacttgatcgaaaagctgggtgataagatcggggagtccgagatccagcgcttgaaggattacagggctcgctacggagccgaatagatccggtgcattagcattataggcaaaaaatagacgacgaaatgatcatatttttcttgtaaatacgctgatttggcgcacattccttccccgttgtcggtgtatcgaaaatcgggtgaagaggcatttcttacgttcttttttggattatcttttttatttatagattcaatagtgtcaatttttaattgacatggcttatgtagcatgcccatgtatgtacgactgcttttacgataaatgactcaatatagaacttgttacgtgcatcgttatatatatcttggcgaacgttttgccattctgagcaacaatttgactggcatatggggcagctacactaacatgtgtagatttatgaagactagatctgttattagtagaaatttacaagaatatattgagaatgtacttaagtagcacatgttccggtttcagttaaatgcctacacaagcatatacagttgctcactatatcaaaatggatagacatagtatatatacatgtcccttcaagaatctttcatatgagattcctgcggaatatactttaaaggattgattggaatgcatctgttagatttgccacaggcctcgcaatcaaatcatctactaagccgctgctggaattggcctacctaaaatgtacaaggcatcaacacctagtagtgccaaaaaaatcacgcttttatttcaaaagagtacgcctatctttagtctttccgctgtcaccgacaactactccgtagttcaataagaagtagaacatcaattatcagaaactctttcctgacggggtttctatctatttactaccgaatagtacttttaatatcttgaaacctgctgaagtcagtactactgtgccatagagaaaacaggaaacccctccacgctcggcgtcatttctcccagaccgagagaatgcggcggctaaatgacggcgccgaagcgaccccataaaggctactcggaacatagcctctggatcccggtctcggaaatgcccagcgacccgaggtacaaaaccccagcacttccgagacaacgccatgttaagctcgcctcttcacttcttccacgatcactcgaaccacactgaagcattatttcactctcaattaaaataaccacacggcacaattatccatcgttggataggaggtgagctgatctgctatctatttgttttgtgagtttggggatagtgctgatgagactatatgtaggaactgggtctttcgcaaagctcttacctcgccgtcgcctacgagttcatctacacccccggcgacgaaggcatttaatggaccagctagttcgtctacggagacgagtgaaaatgtgcacacgcgcacattgcgccaaacggcagtgacattgttccggttctccgcgttgacgttcaatccgcacaagatccattactcgacaccgtgggcgagagatgtcgagggtcataaggatattgttgtgcatggaccgttgaatctcatttcgattttgcatctgtggcgcgatacgaggaagaatggaagtggggaggaggtggttcttccggagaagatctcgtacagggcgacgagtccgctgtatgcggaggaggagtatcggattgtgttggaagatggagaggatgggatcgggagggtgcagattgttgcgccaggggaggtggtggctatgaaggcggagattcagtagaaatcgtgtagttagtaggagtgggttgtagatattgtctgtttctagctgggagggatacatgtatggggtgctacacaagagtactaaatgacataccctgagatagaaatagtataggagttatctactgtatagtactacccttttgaacaagtaccgaatcttcaattctatataacttatctgctccacttcattcttaaagtatggttcggacttatcttcggagataaccactccacccccatccttatcgccatcacggcagccttccattccacttcaatccgacactcaactcaacttcacatccactatttatctatcgaccacaactaccccaccctccacacatctcccctgatactcggtacatactagacccactatatactccactgcccaacgacacagaccgaacaagaacagacatggaaaagaaacgcacccgcgttcaac

SEQ ID NO: 39 - DNA, 3063 bp, Aspergillus niger
acagggcagcggacttcatggactacggcaggctgcgccggacattgggacgtgttcatgcgacacttgattcatatcgacagcgggcaatatgattcgctaatatacccttcacggccagtcctcagtttggcctagatttacaattccgtccgcactaaagaatgcagaccgagtattgacttgggcatcagttctgctcaggtcatagcacaaatgcttctgatcggagaatttcggatgtatccgaaacatctgcttgcggctgcacaccgacatgaaaaaggcacgtctcattcatcggaatattccccgtctcaaagttggtgacgtgaacggcacattaaccccaccaatcagacgccagggaggcctgatgctagcccgatgatcgtcaagcgagttccctggacgatgccgtcctccccgatggaacagccattatccatctgctggatgggaatactagcccgttgaaccgagctacttcaggaacagatgttcaagtgtgaccttcccgtctttaagtagtatagcttcacaattgggggttaaggctgcttgtgtcccttgtaagtgaccgacatcagcaatggccgttatgacgaccctccggtatttggtcgcatacgaggtgcagtagtacagcatattagaccaaaagcctccagggtgcttgcattgggatgaacatcgtccaggatcacctccggcggtatccagcaggtgttcagccgaatagccccgtggctgtatttggcagggagtatccttgtcggtttgcatataggtagctgtctagaacttgtgagttcgagctgcgcagttatatgggtgatcgttttccaagtggcatgctagcgacgtggctggaataagctatggtcaccaggcctcatagcacattgctccttcgtaatgcggcaattcaattcctatataacctttctaaagccctcgctacgatcagaaataagcaggccgtgattgaattctggtagtagaccttatgcgaccgcgcgaaattagtaaccgaatcattgatggattgactgcgagatggagattccagtatcattcctacaaccatgctcaagctgggaaaagctgtgaatgaacaattagcagaagataggccgtgatcaagccttgagatgcaatgaatagcaaaaatgtttcaatacctgctatcacaatctttgcagacagattgttactagggtggaaggatatctagttctttgggaacaacacactttgcctgatacatatcttctggagatttcattgttcttctggaaaatgatcagggcaggactttcatcctcttatagtacatcatctcccaataaactaatggtgggaccgaggccagcccggggcatataaccgaccccagagagcccgcgaccccacggtcggcgacgttctccggtcgacgatggcctcaaaaaccggggtcatcccccacgaaaatatccccaattcacaaccagcaccaagccgctgctggaattgttgtgtgtagttaggctagatgacagtactaaaattagcggatctgttgggaatgataattgtagtacaacttcaacttcgctagaaggtccaaaggaataaacttacaggaacaatgatgggctttttcacaactggggcaaattgtctagcttaaacagcgctcttggttgctgttcaaccgttcctggtattatcggtcaccgggcctgccagcgaacagtgttaatataccgaatgagaagcttccaacaaacaaacgaagaagaattgaaaagaatgaaagactgctgcaaagccaggtctcagaagaaggaagaaaagcccaagggaagggaggggaaaaaaaccgaccttacgttaaagcaaggggaagatgagataacctatcgtaaagaaggccggacttcggaggttgccctgtggcacgtgtcccactcccaatcggtcagttacagaccctcaacagagcctaagggttatttagtgcacagaatatgagatccaggactatatagggacaccagttcactctgagatgtttgaaccaggcagatcgggcggtaagcagagaaagaggaacttgggagaggaggagagaaagagagctaacacgatacgtcggtccgatccacgggcctcctcccagacccctcattcctgccattggcctaaggccttcgcccgccttgcccctccttgggaaattgcctaaaagaaaatcataaaaaaaaaaaaagacccatcgatcgttgctgataaccgtcttttcccccaaaacaagtctcaccaccgaatctcactactctggactatttttgtgtttaaccaattgaggctcccaaattattagccttgttccactgaaccctgaaatcttctatcaacacaaaagtcgtcgcaaggaagatctacaacaatgtccgccgctaccatccctgctcctgccgccgagcaagactacaaggagacattgcttcccttgttgatgaagaataacgtcctgtcctttggctcctttatccttaagtccggccgtgaatctccgtacttcttcacctcttctctcctccacactgcgcctttgctccgtgccacctcggcagcctatgccagtgtcttgtctgccccgccattcgtaactgttgcggcggacggtactaccacacccaacttcgacattatctttggcccggcttataagggcattccggtgtgcgcttccgttctgaatgaattagcggtgcgagactctctctccgcgtctgctaagggaacctgggacaatgtcagctactccttcaaccgtaaggaggccaaggaccacggtgaaggaggaaacattgtcggtgctcctctgaagggaaagcgtgttgtcattgtcgacgatgttatcacagctggaaccgccatccgcgaggccgtgagcatcattcagaaggaaggcggtattgttaccggcattgttgtcctacttgatcgcgaggaaagagtcagcgacgctgagcctaagagcgctatcggcgttgcacagagggatcttgg

SEQ ID NO: 40 - DNA, 2831 bp, Aspergillus niger
atctccgtacttcttcacctcttctctcctccacactgcgcctttgctccgtgccacctcggcagcctatgccagtgtcttgtctgccccgccattcgtaactgttgcggcggacggtactaccacacccaacttcgacattatctttggcccggcttataagggcattccggtgtgcgcttccgttctgaatgaattagcggtgcgagactctctctccgcgtctgctaagggaacctgggacaatgtcagctactccttcaaccgtaaggaggccaaggaccacggtgaaggaggaaacattgtcggtgctcctctgaagggaaagcgtgttgtcattgtcgacgatgttatcacagctggaaccgccatccgcgaggccgtgagcatcattcagaaggaaggcggtattgttaccggcattgttgtcctacttgatcgcgaggaaagagtcagcgacgctgagcctaagagcgctatcggcgttgcacagagggatcttggtgaaaacatccccattcgcgcagtgattggtcttcacgacttgatcgaaaagctgggtgataagatcggggagtccgagatccagcgcttgaaggattacagggctcgctacggagccgaatagatccggtgcattagcattataggcaaaaaatagacgacgaaatgatcatatttttcttgtaaatacgctgatttggcgcacattccttccccgttgtcggtgtatcgaaaatcgggtgaagaggcatttcttacgttcttttttggattatcttttttatttatagattcaatagtgtcaatttttaattgacatggcttatgtagcatgcccatgtatgtacgactgcttttacgataaatgactcaatatagaacttgttacgtgcatcgttatatatatcttggcgaacgttttgccattctgagcaacaatttgactggcatatggggcagctacactaacatgtgtagatttatgaagactagatctgttattagtagaaatttacaagaatatattgagaatgtacttaagtagcacatgttccggtttcagttaaatgcctacacaagcatatacagttgctcactatatcaaaatggatagacatagtatatatacatgtcccttcaagaatctttcatatgagattcctgcggaatatactttaaaggattgattggaatgcatctgttagatttgccacaggcctcgcaatcaaatcatctactaagccgctgctggaattggtagaccttatgcgaccgcgcgaaattagtaaccgaatcattgatggattgactgcgagatggagattccagtatcattcctacaaccatgctcaagctgggaaaagctgtgaatgaacaattagcagaagataggccgtgatcaagccttgagatgcaatgaatagcaaaaatgtttcaatacctgctatcacaatctttgcagacagattgttactagggtggaaggatatctagttctttgggaacaacacactttgcctgatacatatcttctggagatttcattgttcttctggaaaatgatcagggcaggactttcatcctcttatagtacatcatctcccaataaactaatggtgggaccgaggccagcccggggcatataaccgaccccagagagcccgcgaccccacggtcggcgacgttctccggtcgacgatggcctcaaaaaccggggtcatcccccacgaaaatatccccaattcacaaccagcaccacacggcacaattatccatcgatatctccatgttggagagcatggttgagtggatgggcttccctatgtattatacttatgagaatgccccgggcccgacaccagcgggtgcttcgcatgcggctatctatccttatggcccgtttgagacgggagatggaacggtgatgttggggatccagaatgagcgtgagtgggctaagttctgtgacatcgtcttgggtcaacccagtcttgctacgaatgagcggtttgtgaataactcgctgcgctcgcagaaccgtgatgagttgaagaagataatctgtgacgtcttctcgtcgctttcggcggagcaggtgattgctcgactggatgcagcggcgattgctaatgccagcgtcaatgatatgcaaggcgtctggaaccacccacagctcaaggctcggcagcgatggacagatgttaagacgcccgcaggaagtgtgccggctctgctacctcctggaatgaccatgggggatgaggatacttatggggcgcgcatggacgctgtccctgatgtgggtgagcataacaaggctattctggccgagttggggctcgacgagggtacggagaaatagctgcagttgaattaatgacatgtacagttgagctagtggacttggctatccttgcgagtattggaacttttaggccctttgtaaataactcagtgcgatggattcacctcgggcaattctactgtccactcacgaggttgaagatacctgcatgtcaaaggatgttcagacgtagaactagtcgaccacaatatggatcttacagtttaatccaattcaggcaacctacccctgctgcccctaatatcaccccgcgacggtatccagcgtaaagtgaatatcggcgcaatatacccatcgccgaagcaagtggatcgggaaaacaggcaaaaagccgacatgcccgccaagaccgaggcagcataaagccgctttatcctcgactacggctacttgcattctgcctggccacctctgaactccactgtggacgatctctttcattggtaattggagctaattcgag

SEQ ID NO: 41 - DNA, 2896 bp, Aspergillus niger
cgctaatatacccttcacggccagtcctcagtttggcctagatttacaattccgtccgcactaaagaatgcagaccgagtattgacttgggcatcagttctgctcaggtcatagcacaaatgcttctgatcggagaatttcggatgtatccgaaacatctgcttgcggctgcacaccgacatgaaaaaggcacgtctcattcatcggaatattccccgtctcaaagttggtgacgtgaacggcacattaaccccaccaatcagacgccagggaggcctgatgctagcccgatgatcgtcaagcgagttccctggacgatgccgtcctccccgatggaacagccattatccatctgctggatgggaatactagcccgttgaaccgagctacttcaggaacagatgttcaagtgtgaccttcccgtctttaagtagtatagcttcacaattgggggttaaggctgcttgtgtcccttgtaagtgaccgacatcagcaatggccgttatgacgaccctccggtatttggtcgcatacgaggtgcagtagtacagcatattagaccaaaagcctccagggtgcttgcattgggatgaacatcgtccaggatcacctccggcggtatccagcaggtgttcagccgaatagccccgtggctgtatttggcagggagtatccttgtcggtttgcatataggtagctgtctagaacttgtgagttcgagctgcgcagttatatgggtgatcgttttccaagtggcatgctagcgacgtggctggaataagctatggtcaccaggcctcatagcacattgctccttcgtaatgcggcaattcaattcctatataacctttctaaagccctcgctacgatcagaaataagcaggccgtgattgaattctggtagtagaccttatgcgaccgcgcgaaattagtaaccgaatcattgatggattgactgcgagatggagattccagtatcattcctacaaccatgctcaagctgggaaaagctgtgaatgaacaattagcagaagataggccgtgatcaagccttgagatgcaatgaatagcaaaaatgtttcaatacctgctatcacaatctttgcagacagattgttactagggtggaaggatatctagttctttgggaacaacacactttgcctgatacatatcttctggagatttcattgttcttctggaaaatgatcagggcaggactttcatcctcttatagtacatcatctcccaataaactaatggtgggaccgaggccagcccggggcatataaccgaccccagagagcccgcgaccccacggtcggcgacgttctccggtcgacgatggcctcaaaaaccggggtcatcccccacgaaaatatccccaattcacaaccagcaccctgtacagtgaccggtgactctttctggcatgcggagagacggacggacgcagagagaagggctgagtaataagcgccactgcgccagacagctctggcggctctgaggtgcagtggatgattattaatccgggaccggccgcccctccgccccgaagtggaaaggctggtgtgcccctcgttgaccaagaatctattgcatcatcggagaatatggagcttcatcgaatcaccggcagtaagcgaaggagaatgtgaagccaggggtgtatagccgtcggcgaaatagcatgccattaacctaggtacagaagtccaattgcttccgatctggtaaaagattcacgagatagtaccttctccgaagtaggtagagcgagtacccggcgcgtaagctccctaattggcccatccggcatctgtagggcgtccaaatatcgtgcctctcctgctttgcccggtgtatgaaaccggaaaggccgctcaggagctggccagcggcgcagaccgggaacacaagctggcagtcgacccatccggtgctctgcactcgacctgctgaggtccctcagtccctggtaggcagctttgccccgtctgtccgcccggtgtgtcggcggggttgacaaggtcgttgcgtcagtccaacatttgttgccatattttcctgctctccccaccagctgctcttttcttttctctttcttttcccatcttcagtatattcatcttcccatccaagaacctttatttcccctaagtaagtactttgctacatccatactccatccttcccatcccttattcctttgaacctttcagttcgagctttcccacttcatcgcagcttgactaacagctaccccgcttgagcagacatcaccatgcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctg

SEQ ID NO: 42 - DNA, 2688 bp, Aspergillus niger
ggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgagccttatctccatgttggagagcatggttgagtggatgggcttccctatgtattatacttatgagaatgccccgggcccgacaccagcgggtgcttcgcatgcggctatctatccttatggcccgtttgagacgggagatggaacggtgatgttggggatccagaatgagcgtgagtgggctaagttctgtgacatcgtcttgggtcaacccagtcttgctacgaatgagcggtttgtgaataactcgctgcgctcgcagaaccgtgatgagttgaagaagataatctgtgacgtcttctcgtcgctttcggcggagcaggtgattgctcgactggatgcagcggcgattgctaatgccagcgtcaatgatatgcaaggcgtctggaaccacccacagctcaaggctcggcagcgatggacagatgttaagacgcccgcaggaagtgtgccggctctgctacctcctggaatgaccatgggggatgaggatacttatggggcgcgcatggacgctgtccctgatgtgggtgagcataacaaggctattctggccgagttggggctcgacgagggtacggagaaatagctgcagttgaattaatgacatgtacagttgagctagtggacttggctatccttgcgagtattggaacttttaggccctttgtaaataactcagtgcgatggattcacctcgggcaattctactgtccactcacgaggttgaagatacctgcatgtcaaaggatgttcagacgtagaactagtcgaccacaatatggatcttacagtttaatccaattcaggcaacctacccctgctgcccctaatatcaccccgcgacggtatccagcgtaaagtgaatatcggcgcaatatacccatcgccgaagcaagtggatcgggaaaacaggcaaaaagccgacatgcccgccaagaccgaggcagcataaagccgctttatcctcgactacggctacttgcattctgcctggccacctctgaactccactgtggacgatctctttcattggtaattggagctaattcgaggatcatgtccagtcaggagtcatcgggccaccgacaggtaagaaccagggccaagcaggcttgtctccactgcaataagcggcgaatccgctgcaatgtgctacagatgcgcccatgccagaattgtctggcattgaatgtaccctgtgaga

SEQ ID NO: 43 - DNA, 2971 bp, Aspergillus niger
atagctttatcgatatttaccacccaattcattccaagtgtggattcataccctcgtcgtccccttaaaactgtgcccgaagacatcacgcctgcagatcatgagatcctactgcgcggcggcacatcttctaacattaaatgatttccttcacgcctgcaaagatcaaaacgtgcatctgcagatctgcatcaccacttagaggatctaacgtacgaagtcagctatcttaaggccgagcttcagtgggagaaagaatcgaagtagatcctcttgtgtttccaggacgacatgttccgtctctttcatcagccggaaatggctctggctcaagtcagcgcaagattgaaggactgtgaaaagcattactatgaatcatggggcttttccactacttcaactgaagaaggaatgatctaaggagctcagggctatcgagtacggtacgacttgtacacgatgatatggtatgcaagcgaatacatcactggcagtaatctaaatatcgaatacttagcccccatagaagaaccgcagctgcgtttagtctattggaagactctagtgtctggtgaaaggacgattaagtccgaataactgcccagtaacatagagagtggcctatattggtcaaacgtctgaagaggggaattctatgcttgcggcctcatttgatgtcaagcttagcacggataaaagcgtgtttagtatgtgtatgctgtttcttcccctggtctaatttgaagtgctatgttcttcattctatctcttcatactcttagaaggttctaattatcctatcgtcctctcatctctagatctggactatataggcgtcaattgagtgacagtggcatggtgattattggcagtataaagatatttgtctatattataagcgactgatggcaacgcgcccacctgactatttcggtagacttgaattagcaggatactgtatcttacggttgatatttaattagtgcgagaattagcgatatgacaacgcggaatagctatccctggctgaagttctgcccttcaatcttcgaggtgtaatccagcggcaacatccgttgaacacgtgcggggtggaagtccccgacgaacttgtcgacgcgacgaaatctgtatgttttcagagtaacctcacgtatccgcgtcttccgggttgacagcataagatgatatcagtgtaatataataagtaagcaagtaagcagggctgacgaagattgttcctatcccgtgatactttaacagagaagccaatcatgtttccgccgaaaccggcactttcgaggtaccaccaccactataacatcatcccacttatatacctcacaacaatataaatactgaagttcctatacatcgtcaacactaacaacacatccatctacaaccaccagctgttaaacatcaattgtgtgtagttaggctagatgacagtactaaaattagcggatctgttgggaatgataattgtagtacaacttcaacttcgctagaaggtccaaaggaataaacttacaggaacaatgatgggctttttcacaactggggcaaattgtctagcttaaacagcgctcttggttgctgttcaaccgttcctggtattatcggtcaccgggcctgccagcgaacagtgttaatataccgaatgagaagcttccaacaaacaaacgaagaagaattgaaaagaatgaaagactgctgcaaagccaggtctcagaagaaggaagaaaagcccaagggaagggaggggaaaaaaaccgaccttacgttaaagcaaggggaagatgagataacctatcgtaaagaaggccggacttcggaggttgccctgtggcacgtgtcccactcccaatcggtcagttacagaccctcaacagagcctaagggttatttagtgcacagaatatgagatccaggactatatagggacaccagttcactctgagatgtttgaaccaggcagatcgggcggtaagcagagaaagaggaacttgggagaggaggagagaaagagagctaacacgatacgtcggtccgatccacgggcctcctcccagacccctcattcctgccattggcctaaggccttcgcccgccttgcccctccttgggaaattgcctaaaagaaaatcataaaaaaaaaaaaagacccatcgatcgttgctgataaccgtcttttcccccaaaacaagtctcaccaccgaatctcactactctggactatttttgtgtttaaccaattgaggctcccaaattattagccttgttccactgaaccctgaaatcttctatcaacacaaaagtcgtcgcaaggaagatctacaacaatgtccgccgctaccatccctgctcctgccgccgagcaagactacaaggagacattgcttcccttgttgatgaagaataacgtcctgtcctttggctcctttatccttaagtccggccgtgaatctccgtacttcttcacctcttctctcctccacactgcgcctttgctccgtgccacctcggcagcctatgccagtgtcttgtctgccccgccattcgtaactgttgcggcggacggtactaccacacccaacttcgacattatctttggcccggcttataagggcattccggtgtgcgcttccgttctgaatgaattagcggtgcgagactctctctccgcgtctgctaagggaacctgggacaatgtcagctactccttcaaccgtaaggaggccaaggaccacggtgaaggaggaaacattgtcggtgctcctctgaagggaaagcgtgttgtcattgtcgacgatgttatcacagctggaaccgccatccgcgaggccgtgagcatcattcagaaggaaggcggtattgttaccggcattgttgtcctacttgatcgcgaggaaagagtcagcgacgctgagcctaagagcgctatcggcgttgcacagagggatcttgg

SEQ ID NO: 44 - DNA, 2967 bp, Aspergillus niger
atctccgtacttcttcacctcttctctcctccacactgcgcctttgctccgtgccacctcggcagcctatgccagtgtcttgtctgccccgccattcgtaactgttgcggcggacggtactaccacacccaacttcgacattatctttggcccggcttataagggcattccggtgtgcgcttccgttctgaatgaattagcggtgcgagactctctctccgcgtctgctaagggaacctgggacaatgtcagctactccttcaaccgtaaggaggccaaggaccacggtgaaggaggaaacattgtcggtgctcctctgaagggaaagcgtgttgtcattgtcgacgatgttatcacagctggaaccgccatccgcgaggccgtgagcatcattcagaaggaaggcggtattgttaccggcattgttgtcctacttgatcgcgaggaaagagtcagcgacgctgagcctaagagcgctatcggcgttgcacagagggatcttggtgaaaacatccccattcgcgcagtgattggtcttcacgacttgatcgaaaagctgggtgataagatcggggagtccgagatccagcgcttgaaggattacagggctcgctacggagccgaatagatccggtgcattagcattataggcaaaaaatagacgacgaaatgatcatatttttcttgtaaatacgctgatttggcgcacattccttccccgttgtcggtgtatcgaaaatcgggtgaagaggcatttcttacgttcttttttggattatcttttttatttatagattcaatagtgtcaatttttaattgacatggcttatgtagcatgcccatgtatgtacgactgcttttacgataaatgactcaatatagaacttgttacgtgcatcgttatatatatcttggcgaacgttttgccattctgagcaacaatttgactggcatatggggcagctacactaacatgtgtagatttatgaagactagatctgttattagtagaaatttacaagaatatattgagaatgtacttaagtagcacatgttccggtttcagttaaatgcctacacaagcatatacagttgctcactatatcaaaatggatagacatagtatatatacatgtcccttcaagaatctttcatatgagattcctgcggaatatactttaaaggattgattggaatgcatctgttagatttgccacaggcctcgcaatcaaatcatctacttatttcggtagacttgaattagcaggatactgtatcttacggttgatatttaattagtgcgagaattagcgatatgacaacgcggaatagctatccctggctgaagttctgcccttcaatcttcgaggtgtaatccagcggcaacatccgttgaacacgtgcggggtggaagtccccgacgaacttgtcgacgcgacgaaatctgtatgttttcagagtaacctcacgtatccgcgtcttccgggttgacagcataagatgatatcagtgtaatataataagtaagcaagtaagcagggctgacgaagattgttcctatcccgtgatactttaacagagaagccaatcatgtttccgccgaaaccggcactttcgaggtaccaccaccactataacatcatcccacttatatacctcacaacaatataaatactgaagttcctatacatcgtcaacactaacaacacatccatctacaaccaccagctgttaaacatcaacggggttgaggccgtatttggatgggttgaggggagaggaggaacggggggagtttttgaaggtgtatgaggagaaattgagggagaagtatgagaaaagggctgatgggagggtattgttgaggtatcccaggttgtttgctgttgctgttcggaagtgattttcttctcttgtttatttacgagattgggtttggaggtgcagtgtataggtagaggacagaatggaggatgctctgatcatgtcatccaagcttccagtgtatatggcaggcatgcatgctggtataatcctaagtttatagctcgcatatggaatatatcgtcaggtccatgtaagccgtcacgcaggtacatagcttggcctagcaagcttatagctggactgaaccacctcaattgatcctgtgatacaaattaaaatgcatgactcaaacagtttcaccagaaatctcgccagcgctcgatcattccccggacgccatcaagttagaatgctgagattgaaagcgggacacgaacaaggaacgcagttacacagaaccacattaccacctggttcaatgccaattacataattgcaaaatggtacagatcgtcaatccatgcataatagcattgtctataccccagcttcatcgaaatagatcacttactgcagactccctccttcacagcatacccgacggccatcccgatcaaggggaccgaatgccccggaatcatcaacccacattccacgcccccttatattaccacaaatctccactacaatccccgcgttcaaggaacgccccttagctaacccaaacaagggcgcgtcaacaaaccgaccgccatacggcgtaacatgcctcattccgccctgaagaactgattccccaccaataccttactgcggaaatcatttacccggagtatccaggcacaatccaatcaagccatgcatgcacccacgcaggtgtacacaggcatgccttgaagatgccaacgcgttcgcttatttcctccttctctcccctcccttgaagaatcgaatataaaatccagcttgatatccacgacagattctctttttcatccatcagcaacaatcacagcagcagtctagcagccaatactttctcttccacgacaacaatcaaaatgcaattcaccaccttcctttccctggccatcgcggccgtcgttcccgctctggctgcggacaacgctgctcaggaga

SEQ ID NO: 45 - protein, 417 aa, Aspergillus niger; identical to SEQ ID NO: 2

SEQ ID NO: 46 - protein, 471 aa, Aspergillus niger
MRHASTSATKKAGPLAGITVVSLEQAIAAPFCTRQLADLGARVIKVERPGVGDFARNYDTRVNGLASHFVWTNRSKESLALDLKKPSDHSVLMRLLGRADVLVQNLAPGASARLGLSYDDLKAAHPSLIVCNISGYGPDGPYRDKKAYDLLIQSEAGMLSVTGTGKEPAKVGISIADISAGSYAYSNILAALYQRERDPSKRGCNIDISMLESMVEWMGFPMYYTYENAPGPTPAGASHAAIYPYGPFETGDGTVMLGIQNEREWAKFCDIVLGQPSLATNERFVNNSLRSQNRDELKKIIGAAPAGASHAAIYPYGPFETGDGTVMLGIQNEREWAKFCDIVLGQADLATDERFVNNSLRSQNRDELKKIICDVFSSLSAEQVIARLDAAAIANASVNDMQGVWNHPQLKARQRWTDVKTPAGSVPALLPPGMTMGDEDTYGARMDAVPDVGEHNKAILAELGLDEGTEK

SEQ ID NO: 47 - protein, 417 aa, Aspergillus kawachii
MPTTRPIVRAACHSLSSIRHASTNTAKKAGPLAGITVVSLEQAIAAPFCTRQLADLGARVIKVERPGVGDFARNYDTRVNGLASHFVWTDRSKESLALDLKKPSDHSVLMRLLSRADVLVQNLAPGASARLGLSYADLKAAHPSLIVCNISGYGPDGPYRDKKAYDLLIQSEAGMLSVTGTGKEPAKVGISIADISAASYAYSNILAALYQRERDPAKQGCNIDISMLESMVEWMGFPMYYSYENAPGPTPAGASHAAIYPYGPFETGDGTVMLGIQNEREWAKFCDIVLGQADLATDERFVNNSLRSQNRDELKKIICDVFSSLSAEQVIARLDEAAIANASVNDMQGVWNHPQLKARQRWTDVETPAGTVPALLPPGMTLGDADTYGARMDAVPEVGEHNKAILAELGLDEGTEK

SEQ ID NO: 48 - protein, 417 aa, Aspergillus niger
MPTTRPIVRAACHNISSIRHASTNTAKKAGPLAGITVVSLEQAIAAPFCTRQLADLGARVIKVERPGVGDFARNYDTRVNGLASHFVWTNRSKESLALDLKKPSDHSVLMRLLGRADVLVQNLAPGASARLGLSYADLKAAHPSLIVCNISGYGPDGPYRDKKAYDLLIQSEAGMLSVTGTGKEPAKVGISIADISAGSYAYSNILAALYQRERDPAKRGCNIDISMLESMVEWMGFPMYYTYENAPGPTPAGASHAAIYPYGPFETGNGTVMLGIQNEREWAKFCDIVLGQADLATDERFVNNSLRSQNRDELKKIICDVFSTLSAEQVIARLDEAAIANASVNDMQGVWNHPQLKARQRWTNVETPAGTVPALLPPGMTMGDADTYGARMDAVPEVGEHNKAILAELGLDVDAEK

SEQ ID NO: 49 - protein, 414 aa, Aspergillus terreus; identical to SEQ ID NO: 4

SEQ ID NO: 50 - protein, 414 aa, Aspergillus terreus
MSLSRPLARAWAQMLAPSTRRHTSTQAGKTGPLTGITVVSLEQAIAAPFCTRQLADLGARVIKVERPGVGDFARNYDTRVNGLASHFVWTNRSKESLALDVKKPRDHQVLMRLLSKADVLVQNLAPGASARLGLSHEDLKATNPSLIVCNISGYGPDGPYRDKKAYDLLIQSEAGMLSVTGTGKEPAKVGISIADISAGCYAYSNILAALIQRDKDPKRRGCNIDISMLESMVEWMGFPMYYTYANAPGPTPTGASHAAIYPYGPFETGDGSVMLGIQNEREWTNFCDKVLGKPELTTDSRFVNNSLRSQNREELKIIICEVFSSLTAEQVIARLDGASIANASVNDMQGVWKHPQLKARGRWTEIETPAGTVPALFPPGMDGSANFTARMDAVPAVGEHNESILAELGMKESK

SEQ ID NO: 51 - protein, 418 aa, Aspergillus nomius
MAPMRPLSQALGLRLPGARNVSTQASPKGPLSGITVVSLEQAIAAPFCTRQLADLGARVIKIERPGVGDFARNYDTRVNGLASHFVWTNRSKESLALDLKKPRDHGVLMRLLGKADVLVQNLAPGASARLGLSHEELKIKHPSLIVCNISGYGPDGPYRDKKAYDLLIQSEAGMLSVTGTAQEPAKVGISIADISAGSYAYSNILAAIIQRGNDPEKRGCNIDISMLESMVEWMSFPLYYTYQNAPRPTPTGATHAAVYPYGPFETGDGKSVMLGIQNEREWVNFCEKVLSLPDLAADERFVNNSLRSQNRDALKEIICEAFSSLTAEKVVTLLDEAAIANGNVNDMQGVWEHPQLKARGRWTEVSTPAGTVPALLPPGLTQGDPGRFSARMDAVPDVGEHNAAILAELGIDDAGKDS

SEQ ID NO: 52 - protein, 418 aa, Aspergillus parasiticus
MAPLRPLSQALYSRIPGARGVSTQASPKGPLSGITVVSLEQAIAAPFCTRQLADLGARVIKIERPGVGDFARNYDTRVNGLASHFVWTNRSKESLALDLKKPRDHGVLMRLLGKADVLVQNLAPGASARLGLSHEELKAKHPSLIVCNISGYGPDGPYRDKKAYDLLIQSEAGMLSVTGTAQEPAKVGISIADISAGSYAYSNILAAIIQRGNDPEKRGCNIDISMLESMVEWMSFPLYYTYQNAPRPTPTGASHAAVYPYGPFETGDGKSVMLGIQNEREWVNFCEKVLSLPHLATDERFVNNSLRSQNRDALKDIICEAFSSLTAERVVTLLDEAAIANGNVNDMQGVWEHPQLKARGRWTEVSTPAGTVPALLPPGLTQGDPGRFSARMDAVPDVGEHNAAILAELGIADAGEDV

SEQ ID NO: 53 - protein, 418 aa, Aspergillus oryzae
MAPWRPLSQALYSRIPGARSVSTQTSPKGPLSGITVVSLEQAIAAPFCTRQLADLGARVIKIERPGVGDFARNYDTRVNGLASHFVWTNRSKESLALDLKKPRDHGVLMRLLGKADVLVQNLAPGASARLGLSHEELKAKHPSLIVCNISGYGPDGPYRDKKAYDLLIQSEAGMLSVTGTAQEPAKVGISIADISAGSYAYSNILAAIIQRGNDPEKRGCNIDISMLESMVEWMSFPLYYTYQNAPRPTPTGASHAAVYPYGPFETGDGKSVMLGIQNEREWVNFCEKVLSLPDLMTDERFVNNSLRSQNRDALKEIICEAFSSLTAEKVVTLLDEAAIANGKVNDMQGVWEHPQLKARGRWTEVSTPAGTVPALLPPGLTQGDAGRFSARMDAVPDVGEHNAAILAELGIEDAGEDL

SEQ ID NO: 54 - protein, 418 aa, Aspergillus flavus
MAPWRPLSQALYSRIPGARSVSTQTSPKGPLSGITVVSLEQAIAAPFCTRQLADLGARVIKIERPGVGDFARNYDTRVNGLASHFVWTNRSKESLALDLKKPRDHGVLMRLLGKADVLVQNLAPGASARLGLSHEELKAKHPSLIVCNISGYGPDGPYRDKKAYDLLIQSEAGMLSVTGTAQEPAKVGISIADISAGSYAYSNILAAIIQRGNDPEKRGCNIDISMLESMVEWMSFPLYYTYQNAPRPTPTGASHAAVYPYGPFETGDGKSVMLGIQNEREWVNFCEKVLSLPDLMTDERFVNNSLRSQNRDALKEIICEAFSSLTAEKVVTLLDEAAIANGKVNDMQGVWEHPQLKARGRWTEVSTPAGTVPALLPPGLTQGDPGRFSARMDAVPDVGEHNAAILAELGIEDAGEDL

SEQ ID NO: 55 - protein, 418 aa, Aspergillus flavus
MAPWRPLSQALYSRIPGARSISTQTSPKGPLSGITVVSLEQAIAAPFCTRQLADLGARVIKIERPGVGDFARNYDTRVNGLASHFVWTNRSKESLALDLKKPRDHGVLMRLLGKADVLVQNLAPGASARLGLSHEELKAKHPSLIVCNISGYGPDGPYRDKKAYDLLIQSEAGMLSVTGTAQEPAKVGISIADISAGSYAYSNILAAIIQRGNDPEKRGCNIDISMLESMVEWMSFPLYYTYQNAPRPTPTGASHAAVYPYGPFETGDGKSVMLGIQNEREWVNFCEKVLSLPDLMTDERFVNNSLRSQNRDALKEIICEAFSSLTAEKVVTLLDEAAIANGKVNDMQGVWEHPQLKARGRWTEVSTPAGTVPALLPPGLTQGDPGRFSARMDAVPDVGEHNAAILAELGIEDAGEDL

SEQ ID NO: 56 - protein, 411 aa, Aspergillus ruber
MLRRPTWQLCRRWGTRALSTKTTDGPLTGITVVSLEQAISAPFCTRQLADLGARVIKIERPGVGDFARHYDTRVNGLASHFVWTNRSKESLALDVKNPRDHRVLMRLLGRADVLVQNLAPGASGRLGLSYEVLKANHPSLIVCNISGYGPDGPYRDKKAYDLLIQSEAGMLSVTGTGAKQPAKVGISIADIAAGSYAYSNILAALFRRERDPKKCGCNLNISMLESMVEWMGFPLYYTYEGAPGPTPAGAAHAAIYPYGPFETGDGKSVMLGIQNEREWASFCDKVLGQPGLAKDGRFVSNSLRVQNRDALKIIICDVFALRTAEDVLALLDKASIANASVNDMQGVWNHPQLQARQRWTEVQTPSSVVPTLLPPGMGADADGLNARIGAVPNVGEHNEAILAELGIDDTD

SEQ ID NO: 57 - protein, 423 aa, Aspergillus udagawae
MAIVRPSVRALPRQFLIIHRNSSTNTPATQNNTRRQKKKGPLSGITVVSLEQAIAAPFCTRQLADLGARVIKIERPKVGDFARNYDTRVNGLSSHFVWTNRSKESLALDVKNPSDYHILMRLLSCADVLVQNLAPGASARLGLSFADLSEKHPSLIVCNISGYGPDGPYRDKKAYDLLIQSEAGLLSVTGTGTEPAKVGISIADICAGSYAYSNILAALFEREKDPERRGRNIDISMLESMVEWMGFPMYYTYGDQPGPTPAGASHAAIYPYGPFETGKGTVMLGIQNEREWARFCEIVLERPEMAMDERFCNNSLRVKNRAVLRETICNVFASYSAEGILQRLDEAGIANASVNDMQGVWNHPQLRARQRWTQIQTSAGTVPALFPPGMGPEGFEAQMGAVPEVGEHNEAILAELGIDTDLD

SEQ ID NO: 58 - protein, 423 aa, Aspergillus fumigatus
MALVRPSVRALPRQLLIIHRNSSTSTSAIQDNIKQQQKKGPLSGITVVSLEQAIAAPFCTRQLADLGARVIKIERPKVGDFARNYDSRVNGLSSHFVWTNRSKESLALDVKNARDHRILMRLLSRTDVLVQNLAPGASARLGLSFADLSEKHPSLIVCNISGYGPDGPYRDKKAYDLLIQSEAGLLSVTGTATEPAKVGISIADICAGSYAYSNILAALFERERDPERRGRNIDISMLESMVEWMGFPMYYTYGDQPGPTPAGAAHAAIYPYGPFETGKGTVMLGIQNEREWAKFCEMVLEKPEMTTDERFCNNSLRVKNRDALRETICKVFAAYSAEGVLRRLDEAGIANAIVNDMQGVWNHPQLRARQRWTQIQTPAGAVPALFPPGTGPDGFEAQMGAVPEIGQHNEAILAELGIDTDIE

SEQ ID NO: 59 - protein, 423 aa, Aspergillus fischeri
MALVRPSVRALPRQLLIIHRNSSTSTSVTQNNVKRQQKKGPLSGITVVSLEQAIAAPFCTRQLADLGARVIKIERPEVGDFARNYDTRVNGLSSHFVWTNRSKESLALDVKNARDHRILMRLLSRADVLVQNLAPGASARLGLSFADLSEKHPSLIVCNISGYGPDGPYRDKKAYDLLIQSEAGLLSVTGTATEPAKVGISIADICAGSYAYSNILAALFERERDPERRGRNIDISMLESMVEWMGFPMYYTYGDQPGPTPAGASHAAIYPYGLFETGKGTVMLGIQNEREWAKFCEMVLEKPEMTTDERFCNNSLRVKNRDALRETICKVFAAYSAEGVLRRLDEAGIANAIVNDMQGVWNHPQLRARQRWTQIQTSAGAVPALFPPGMGPDGFEAQMGAVPEIGQHNEAILAELGMDTDIG

SEQ ID NO: 60 - protein, 421 aa, Aspergillus calidoustus
MFGRLSRTQCIPLPTISGSIRHFSLSAARRNQGPLSDITVVSLEQAIAAPFCTRQLADLGARVIKVERPGVGDFARNYDTRVNGLASHFVWTNRSKESLALDVKKPSDHAVLMKLLGKADVLVQNLAPGASSRLGLSFDDLKESHPGLIVCDISGYGQDGPYRDKKAYDLLVQSEAGMLSVTGTGNEPAKVGISIADIASGMYAYSNILAALLQRSKTGRGSHIDISMLESMVEWMGFPMYYAYNGAPGPVPAGASHASIYPYGPFETGDGQSVMLGIQNEREWANFCTLVLSQPDLATDARFSTNSVRTQNREALKDIIHKSFADLTAGEATRRLDEASIANANVNDMHGVWEHAQLRSRNRWTEVQTPEGPVPALLPPGFAPLSSGNEGVHARMDPVPKVGEHNESILAELGITTSNKE

SEQ ID NO: 61 - protein, 416 aa, Aspergillus nidulans
MFARASCPRCLSQPAISRSVRRFSCAAARRNSDNQGPLAGITVVSLEQAIAAPFCTRQLADMGARVIKIERPGVGDFARGYDTRVNGLASHFVWTNRSKESLALDVKNPEDHEVLMRLVSKADVLVQNLAPGASARLGLSFETLKEEHPSLIVCDISGYGQDGPYRDKKAYDLLVQSEAGMLSVTGTGKEPAKVGISIADIASGMYAYSNILAALMQRSKTGRGSHIDISMLESMVEWMGFPMYYAFNGAPGPVPAGASHASIYPYGPFETGNGSVMLGIQNEREWAKFCTLVLSQPDLITDARFSNNSLRVQNRDALKEIIHKSFANITAEEATRRLDEAAIANANVSDMQGVWEHTQLRARNRWTEVKTPGGTVPALLPPGFSPRGGFRPRMDAVPEVGEHNESIFAELGFTRK

SEQ ID NO: 62 - protein, 343 aa, Aspergillus nidulans
MGARVIKIERPGVGDFARGYDTRVNGLASHFVWTNRSKESLALDVKNPEDHEVLMRLVSKADVLVQNLAPGASARLGLSFETLKEEHPSLIVCDISGYGQDGPYRDKKAYDLLVQSEAGMLSVTGTGKEPAKVGISIADIASGMYAYSNILAALMQRSKTGRGSHIDISMLESMVEWMGFPMYYAFNGAPGPVPAGASHASIYPYGPFETGNGSVMLGIQNEREWAKFCTLVLSQPDLITDARFSNNSLRVQNRDALKEIIHKSFANITAEEATRRLDEAAIANANLRARNRWTEVKTPGGTVPALLPPGFSPRGGFRPRMDAVPEVGEHNESIFAELGFTRK

SEQ ID NO: 63 - protein, 434 aa, Aspergillus calidoustus
MNPLLRTIVCPSARVVRANSTIPSKTTKTGPLAGIKILDLTRVLAGPFCTQILADYGADVIKVENPKGGDDTRLWRESGEDAIWKPDEAGTKTSLYFNTINRNKRSIALDLKSEAGKKVVLQLARGADVVVENFIPGKLDKLGLGYETLKAVNPQLILASISGYGASGPYAHRAGYDVIGAAEGGLLHITGEPDGRPTKPGVGLMDMCTGLYLHGAIVSALLARERTGEGQKLDTSLFETTISILSNVGMSWLNLGREAKRWGTGHPTIVPYEAFRTADSWFVMGAVNDRQFGVLCGLLGVEELVSDERFRGNDERVRNRGVLREILEGVMVTRTTGDWETVFEGSGMPYGPINNLEQVFGHPQALARGMVETVASGAAVSGEVKVLGIPVKFSGTKPSIREGPPALGQHTEEVLKELGLSAEDVSKLRKDKVI

SEQ ID NO: 64 - protein, 447 aa, Aspergillus oryzae
MSVTLKLHQAFRARRPALRWSSSVLRTTAQWRTYSSTPADDTLPLKGVRVLDMTRVLAGPYCTQILGDLGADVIKIEHPVRGDDTRAWGPPYAKYQDESRQGPGESAYYLGVNRNKKSLGLSFQHKSGVEILHRLAKECDVLVENYLPGSLKKYNMDYETLREINPKLIYASITGYGQTGPYSNRAGYDVMVEAEMGLMHITGARGGDPVKVGVAVTDLTTGLYTSNAIMAALLARVRTGMGQHIDACLSDCQVATLANIASSALISGEKDTGRWGTAHPSIVPYRSYQTLDGDILFGGGNDRLFGVLCDRLGHPEWKTDPRFVTNSDRVKNRGEIDGLIEEKVKQKTTQEWLEILEGSGMPYAAVNDIQGTLNHSHVQARGMVTEVDHPACGPIKLVNTPIKYSHATPGVRTPPPTLGQHTDEILEEILEYGKDDIARLKQDGVVS

SEQ ID NO: 65 - protein, 447 aa, Aspergillus parasiticus
MSVTLKLHQAVIARRPALRWSSSVLRTTAQWRTYSSTPADDTLPLKGVRVLDMTRVLAGPYCTQILGDLGADVIKIEHPVRGDDTRAWGPPYAKYQDESRQGPGESAYYLGVNRNKKSLGLSFQHKSGVEILHRLAKECDVLVENYLPGSLKKYNMDYETLREINPKLIYASITGYGQTGPYSNRAGYDVMVEAEMGLMHITGARGGDPVKVGVAVTDLTTGLYTSNAIMAALLARVRTGKGQHIDACLSDCQVATLANIASSALISGEKDTGRWGTAHPSIVPYRSYQTLDGDILFGGGNDRLFGVLCDRLGHPEWKTDPRFVTNSDRVKHRREIDGLIEEKVKQKTTQEWLEILEGSGMPYAAVNDIQGTLNHSHVQARGMVTEVDHPACGPIKLVNTPIKYSHATPGVRTPPPTLGQHTDEILEEILEYGKDDIARLKQDGVVS

SEQ ID NO: 66 - protein, 443 aa, Aspergillus kawachii
MNLTAALRVQRACVARRSIYLPRRTTQWRSYSSAVSDDTLPLKGIRVLDMTRVLAGPYCTQILGDLGADVIKVEHPVRGDDTRAWGPPYATYTDGSEGPGESAYYLGVNRNKKSIGLSFAHKSGVEILHRLAKECDVLVENYLPGSLKKYNMDYETLRSINPRLIYASITGYGQTGPYSNRAGYDVMVEAEMGLMHITGSREGEPVKVGVAVTDLTTGLYTSNAIMAALLARARTGKGQHIDACLSDCQVATLANIASSALISGKKDSGRWGTAHPSIVPYRSYKTLDGDILFGGGNDRLFGVLCDRLGHPEWKTDPRFVTNSDRVKHRTDIDGLIEETVKQKTTQEWLEILEGSGMPYAAVNDIQGTLNHSHVQARGMVTEVDHPACGPIKLVNTPIKYSHATPGIRTPPPTLGQHTDEILGEVLEYGKDDIARLKKDGVVA

SEQ ID NO: 67 - protein, 442 aa, Aspergillus nidulans
MLLSRAPLRLLKPIGVSIRSLATHAKSKNKKLPLAGLKVLDLSRVLAGPYCTQILGDLGADIIKIEHPVRGDDTRAWGPPYAPYIDGREGPGESAYYLSVNRNKRSLALSFAHPQGQNILHRLVREADILVENYIPNSLAKYKLDYPTLSTINPSLIYTSITGYGQTGPYSNRPGFDVMVEAEFGLAHLTGSKNGPPVKVGVAVTDLTTGLYAVQSILAALWQRAQSKENGEAGKGEGQHLDVCLSDCQVATLANMGQGPLISGQKDSGRWGTAHPSVVPYQSFATADGDIFVGGANDKLFGILCARLNKPEWACDARFVTNSDRVANRSVLEEMIEHETRKLSTKEWQERFQGSGLPFAVVNDVLGTMGHEHVQARGMVQTIAHPACGLIKVISPPVKYSNAEPSIRRAPPLLGEHTDEVLMEIGLSELEIAGLRKEKIVA

SEQ ID NO: 68 - protein, 447 aa, Aspergillus fumigatus
MNGAWALQRAMARRPSLYSLRTILKCKPQGRRFSAIPTSDETLPLKGIRVLDMTRVLAGPYCTQILGDLGADIIKVEHPVRGDDTRAWGPPYAKYIDGSHDGPGESAYFLAVNRNKRSIGLSFAHKSGVEILHKLAKECDVLVENYLPGTLKKYGLDYETLRSINPRLIYASITGYGQTGPYSNRAGYDVMVEAEMGLMHITGSRDGDPVKVGVAVTDLTTGLYTSNAIMAALLARMRTGQGQHIDACLSDCQVATLANIASSALISGEKDSGRWGTAHPSIVPYRSYQTLDGDILFGGGNDRLFGVLCDRLGFPEWKTDPRFITNRDRVKHREELDDLIEKRVKQKTTQEWLEILEGSGMPYAAINDIQGTLNHSHVQARGMVTEVDHPACGPVKLVNTPIKYSHATPGVRRPPPTLGQHTDEILKELLNYDKADIDLLKKEGIVS

SEQ ID NO: 69 - protein, 443 aa, Aspergillus niger
MNPTAALRVQRACIARRSIYVPRRTTQWRSYSSAVSDDTLPLKGIRVLDMTRVLAGPYCTQILGDLGADVIKIEHPVRGDDTRAWGPPYATYTDGSEGPGESAYYLGVNRNKKSIGLSFAHKSGVEILHRLAKECDVLVENYLPGNLKKYNMDYETLRSINPKLIYASITGYGQTGPYSNRAGYDVMVEAEMGLMHITGSREGEPVKVGVAVTDLTTGLYTSNAIMAALLARARTGKGQHIDACLSDCQVATLANIASSALISGKKDSGRWGTAHPSIVPYRSYKTLDGDILFGGGNDRLFGVLCDRLGHPEWKTDPRFVTNSDRVKHRTDIDGLIEETVKQKTTQEWLEILEGSGMPYAAVNDIQGTLNHSHVQARGMVAEIDHPACGPIKLVNTPIKYSHATPGIRTPPPTLGQHTDEILGELLEYGKDDIARLKKDGVVA

SEQ ID NO: 70 - protein, 448 aa, Aspergillus fischeri
MNAACMLQRAVARRPSLYSSRTIILKCTPQGRRFSAIPTSDDTLPLKGIRVLDMTRVLAGPYCTQILGDLGADIIKVEHPVRGDDTRAWGPPYAKYIDGSHDGPGESAYFLAVNRNKRSIGLSFAHKSGVEILHKLAKECDVLVENYLPGTLKKYGLDYETLRSINPRLVYASITGYGQTGPYSNRAGYDVMVEAEMGLMHITGSRDGDPVKVGVAVTDLTTGLYTSNAIMAALLARMRTGQGQHIDACLSDCQVATLANIASSALISGEKDSGRWGTAHPSIVPYRSYQTLDGDILFGGGNDRLFGVLCDRLGFPEWKTDPRFITNRDRVKHREELDGLIEKRVKQKTTQEWLEILEGSGMPYAAINDIQGTLNHSHVQARGMVTEVDHPACGPVKLVNTPIKYSHATPGVRRPPPTLGQHTDEILEELLNYDKANIELLKKEGIVS

SEQ ID NO: 71 - protein, 447 aa, Aspergillus clavatus
MNATLKLHWAVARRPSLYLSKTIPRCTPQRRRFSAIPASEDTLPLKGIRVLDMTRVLAGPYCTQILGDLGADIIKVEHPVRGDDTRAWGPPYAKYTDESRKGPGESAYYLAVNRNKRSIGLSFAHKSGIEILHKLAKECDVLVENYIPGSLKKYGLDYETLRSINPKLIYASITGYGQTGPYSNRAGYDVMVEAEFGLMHITGSRDGDPVKVGVAVTDLTTGLYTSNAIMAALLARVRTGQGQHIDACLSDCQVATLANIASSALISGKKDSGRWGTEHPSIVPYRSYKTIDGDILLGGGNDRLFGIICDRLGYPEWKADPRFVTNSDRVKHRKELDGMIEKTIAQKTTQEWLDILEGSGMPYAAINDIQGTLNHSHVQARGMVTEVDHPACGPIKLVNTPIKYSHATPGVRRPPPTLGQHTDEILEEILDYGKSDIARLKKEGVLS

SEQ ID NO: 72 - protein, 451 aa, Aspergillus calidoustus
MNVTFKLQRALIAQRPNVRQLTKSNIIIRQATQWRSYSTPLAGADGTLPLQGIRVLDMTRVLAGPYCTQILGDLGADVIKVEHPTRGDDTRAWGPPHAKYTDNSKGPGESAYYLAVNRNKKSVGLSFQHKSGVEILHKLVKECDVLVENYLPGSLKKYNMDYETLREINPSLIYASITGYGQTGPYSNRAGYDVMVEAEFGLMHITGSRNGDPVKVGVAVTDLTTGLYTSNAIMAALLARVRTGKGQHIDACLSDCQVATLANIASSALISGKKDSGRWGTEHPSIVPYRSYSTLDGDILFGGGNDRLFGVLCDRLGHPDWKEDPRFLTNSDRVKHRAEIDGLIEDRVREKTTQHWLEIMEGSGMPYAAVNDIQGTLNHEHVKARGMIVDVDHPACGPMKLVNTPIKYSHATPGVRTPPPTLGQHTDEILGEVLQYSVKEIAQLKKDGVVS

SEQ ID NO: 73 - protein, 448 aa, Aspergillus ruber
MSVALKFQALVRRSVVNSPIVAAAAGLQRTAPWRRSYSSAIGDTLPLTGIKVLDMTRVLAGPYCTQILGDLGAEVIKVEHPVRGDDTRAWGPPFAKYQDESRQGPGESAYYLAVNRNKKSIGLSFAHKPGVEILHKLVKECDVLVENYLPGGLKKYNMDYETLHAINPKLIYASITGYGQTGPYSNRAGYDVMVEAEMGLMHITGARDGAPVKVGVAVTDLTTGLYTSNAIMAALIARGRTGKGQHIDASLSDCQVATLSNLASSALISGKKDSGRWGTAHPSIVPYRSYKTRDGDILFGGGNDKLFGVLCDRLGYPEWKTDVRFVTNSDRVKHREEVDGLIETTTKQKTTKEWLEIFEGSGMPYAAVNDIQGTLNHSHVQARGMVTEVDHPDCGPVKLVNTPIKYSHATPGIRTAPPTLGQHTDEILGGIEYGKEDIARLKQEGVVS

SEQ ID NO: 74 - protein, 448 aa, Aspergillus fumigatus
MARRPSLYSLRTILKCKPQGRRFSAIPTSDETLPLKGIRVLDMTRVLAGPYCTQILGDLGADIIKVEHPVRGDDTRAWGPPYAKYIDGSHDGPGESAYFLAVNRNKRSIGLSFAHKSGVEILHKLAKECDVLVENYLPGTLKKYGLDYETLRSINPRLIYASITGYGQTGPYSNRAGYDVMVEAEMGLMHITGSRDGDPVKVGVAVTDLTTGLYTSNAIMAALLARMRTGQGQHIDACLSDCQVATLANIASSALISGEKDSGRWGTAHRKLMDMVLPALASIVPYRSYQTLDGDILFGGGNDRLFGVLCDRLGFPEWKTDPRFITNRDRVKHREELDDLIEKRVKQKTTQEWLEILEGSGMPYAAINDIQGTLNHSHVQARGMVTEVDHPACGPVKLVNTPIKYSHATPGVRRPPPTLGQHTDEILKELLNYDKADIDLLKKEGIVS

SEQ ID NO: 75 - protein, 448 aa, Aspergillus fumigatus
MARRPSLYSLRTILKCKPQGRRFSAIPTSDETLPLKGIRVLDMTRVLAGPYCTQILGDLGADIIKVEHPVRGDDTRAWGPPYAKYIDGSHDGPGESAYFLAVNRNKRSIGLSFAHKSGVEILHKLAKECDVLVENYLPGTLKKYGLDYETLRSINPRLIYASITGYGQTGPYSNRAGYDVMVEAEMGLMHITGSRDGDPVKVGVAVTDLTTGLYTSNAIMAALLARMRTGQGQHIDACLSDCQVATLANIASSALISGEKDSGRWGTAHRKLMDMVLPALASIVPYRSYQTLDGDILFGGGNDRLFGVLCDRLGFPEWKTDPRFITNRDRVKHREELDDLIEKRVKQKTTQEWLEILEGSGMPYAAINDIQGTLNHSHVQARGMVTEVDHPACGPVKLVNTPIKYSHATPGVRRPPPTLGQHTDEILKELLNYDKADIELLKKEGIVS

SEQ ID NO: 76 - protein, 440 aa, Aspergillus calidoustus
MILAALRPLLKPNGLSISFRTLATTTTPPKPKQNKKLPLAGLKVLDLSRVLAGPYCTQILGDLGADIIKIEHPVRGDDTRAWGPPYAPYLDGREGQGESAYYLSVNRNKRSLALSFADPRGQRILQKLATQSDILVENYLPGSLKKYSLDYTTLSSLNPRLIYTSITGYGQTGPYANRPGFDVMVEAEFGLAHLTGSRDGPPVKVGVAVTDLTTGLYAVNSILAAVVARATTNEGQHLDVCLSDCQVATLANMGSSVLISGDKDSGRWGTAHPSVVPYQSFPTANGDIFVGGANDRLFGILCERLGKKEWASDARFKSNSDRVANRTVLEALIEAETRRLDTAEWQQRFEGSGLPFAVVNDVKGTMEHEHVQARGMVQTIAHPACGPIKVISPPVKYSNAEPSVRRPPPTLGQHTDEILKELLNYDKADIDLLKKEGIVS

SEQ ID NO: 77 - protein, 450 aa, Aspergillus ochraceus
MNVALKLQRAFIAQRPWLRQPGRNNIVRYATQWRSYSTPVAPADGTLPLQGVRVLDMTRVLAGPYCTQILGDLGADVIKIEHPVRGDDTRAWGPPYAKYKDGSQGPGESAYYLGVNRNKKSLGLSFAHKAGVDILHRLVKECDVLVENYLPGSLEKYNMDYETLREINPKLIYASITGYGQTGPYSNRAGYDVMVEAEMGLMHITGSRDGDPVKVGVAVTDLTTGLYTSNAIMAALLARVRSGKGQHIDACLSDCQVATLANIASSALISGEKDSGRWGTEHPSIVPYRSYQTVDGDILFGGGNDRLFGVLCDRLGHPEWKSDPRFLTNRDRVQHRAEIDGLIEECVKQKTTQEWLDILEGSGMPYAAVNDIQGTLNHAHVQARGMITEIEHPSCGPIKLVNTPIKYSHATPGVRTPPPTLGQHTDEILGQILEYGAADIAQLKKDGVVS

SEQ ID NO: 78 - protein, 1033 aa, Aspergillus nomius
MSVTLKLHQTVLARRSALRWSSSVLRRSAAPWRTYSSTPADDTLPLKGVRVLDMTRVLAGPYCTQILGDLGADVIKIEHPVRGDDTRAWGPPYAKYQDESRQGPGESAYYLGVNRNKKSLGLSFQHKSGVEILHRLAKECDVLVENYLPGSLKKYNMDYETLREINPKLIYASITGYGQTGPYSNRAGYDVMVEAEMGLMHITGARDGDPVKVGVAVTDLTTGLYTSNAIMAALLARMRTGKGQHIDACLSDCQVATLANIASSALISGEKDTGRWGTAHPSIVPYRSYQTLDGDILFGGGNDRLFGVLCDRLGHPEWKTDPRFVTNSDRVKHRGEIDGLIEEKVKQKTTQEWLEILEGSGMPYAAVNDIQGTLNHSHVQARGMVTEVDHPACGPIKLVNTPIKYSHATPGVRTPPPTLGQHTDEILGEILEYGGLMSQQHGVLPTPASIEPAPPAHGTSSGWQTSAPTLERVSPSLSPSLKPSRPPSAISSKVHIPKLSPATTELVARVTGHRKGETQRNGTKFVTWNPPSLHPGWSHPRIQPSGTMKASSTIIELPTAPFVYSSHMTTPAVAQQAPVTAPPTTSPSTHTYTPPLPQGSHDKPTRLVNIAPKPAGPPSIGVPAPPQDSLPPPLPSHPQPIAPAAKDSPPSAKRKRAAVGPRQRRSTTNGTKRKKRRRGNDSDGEDIIRAGDSSSDESDVAPTATQTKSGRQVNRPSLYVPPSASPTVAKDSSNSLDTSDNTQRQVAAARKRKRVYRKPKDGIISCIHCQRGHSPQSNAIVFCYECHGPWHQLCHDPPIEPQVVTVTMKQRPWVCRECKPVPITIMQPTVVRSNPSLTGPSFGPPVHAPLILPKTEVGGEGFSADERRGFLSGLSHATLVELLVTLSDQHPAVPMFPKNLKTLQSKFSFKPNTLAVPTPSSTSSNTPTITNSINHALTDGVDMAQHKSGVTPEFLPTPSSAHQTQHDLSEESEYEFSEHRLYPRAGNGFRLSTKADDVDIMWEDVSCRTFSYALHGPARARAQANEVAPIWGS

SEQ ID NO: 79 - protein, 1110 aa, Aspergillus niger
MNLTAALRVQRACVARRSIYLPRRTTQWRSYSSAVSDDTLPLKGIRVLDMTRVLAGPYCTQILGDLGADVIKVEHPVRGDDTRAWGPPYATYTDGSEGPGESAYYLGVNRNKKSIGLSFAHKSGVEILHRLAKECDVLVENYLPGSLKKYNMDYETLRSINPKLIYASITGYGQTGPYSNRAGYDVMVEAEMGLMHITGSREGEPVKVGVAVTDLTTGLYTSNAIMAALLARARTGKGQHIDACLSDCQVATLANIASSALISGKKDSGRWGTAHPSIVPYRSYKTLDGDILFGGGNDRLFGVLCDRLGHPEWKTDPRFVTNSDRVKHRTDIDGLIEETVKQKTTQEWLEILEGSGMPYAAVNDIQGTLNHSHVQARGMVAEIDHPACGPIKLVNTPIKYSHATPGIRTPPPTLGQHTDEILGEVLECGVQSKSTKTTEQLCTSTRLGDMSPHNGAPSSQASIETAPSSAHGTLHTTTTTSGSPPSDSSRSISIGSSLGLPPSLPGRPSSVPSKRVEIPRLSAATTELLARVTGNLKGPQQRNDNDRFVTWNPSTVTRTFESQNSNSTMGKMRASSTIIELPTAPFVYSNTVAPPAVPQPASPAPQGTTGDIVKSTNLPNLAPKPPGTTPIDAVSRHSGSPVSVNVDLKPTSSTPVDAVSRQSASPIPVNIAPKPSTTPVGAVLAPTQLTAPTSAELTAEIKIAPKPNGTLSNGAAPASTPLPTPQEPQPAAKSKRPQTAAGSRQRKGAANGNKRGKKRKRNNDSDGEDIIRAGDSSSDESDVAPTATQTKSGRLVNRPSLYVPAPSAPAVAKEVSNSADASDYAAIARKRKRIHRRGKDAIITCLHCQRGHSPLSNSIVFCDECNAAWHQLCHDPPIGADVVAVKEKEWFCRECRPVEISVIQPTVVRSNPDLTSGPLVPNYPPLSIPKGEVGAAEFSADERRGFLSGLSHATLVELLMTISDNNPILPMFPEDMRDLQSSKFAFRLPISDAPTPSTSVSGNVSTSNDTRDSTSASTEVNKHNEDSVPDATSSSSTRRRYEEISDDDSEYEFQEHRLYPRAGNGFRLSLNVDDMDIMREDPACPTFSYSLHGPAQVRAQLNEMVPVWGT

SEQ ID NO: 80 - protein, 1065 aa, Asprgillus rambelli
MNVALKLQRAFIAQRPLLRQPGRNNIVRYATQWRSYSTPVAPADGTLPLQGVRVLDMTRVLAGPYCTQILGDLGADVIKIEHPVRGDDTRAWGPPYAKYKDGSQGPGESAYYLGVNRNKKSLGLSFAHKAGVDILHRLVKECDVLVENYLPGSLEKYNMDYETLREINPKLIYASITGYGQTGPYSNRAGYDVMVEAEMGLMHITGSRDGDPVKVGVAVTDLTTGLYTSNAIMAALLARVRSGKGQHIDACLSDCQVATLANIASSALISGEKDSGRWGTEHPSIVPYRSYQTVDGDILFGGGNDRLFGVLCDRLGHPEWKSDPRFLTNRDRVQHRAEIDGLIEECVKQKTTQEWLDILEGSGMPYAAVNDIQGTLNHAHVQARGMITEIEHPSCGPIKLVNTPIKYSHATPGVRTPPPTLGQHTDEILGQILEYGAADIAQLKKDATNPGISTPYRVPRTFSKPAQGMSQQDGVSPSLASIEATPPPTYGTLITTTTLGEHPSTSPIPAHIDSSSRPKSPNSGQSSSATSSKVLIPKLSATTTELLARVAGNIKGTQQQAQRYDQNSGSWTSFPLNPDLNGSNTPVADTMRASSTLIELPTAPFVYSNNKVEPPAVAQKGTSVPPSSNGNSVKPPSLLNIAPKPTLAPPSSTTPVPSQPADTKIQLPPSQPQPPTPATTNPATIKTSSPSGTLTTKQSKAPSNTRQRRSTGTRKRRSKKRRRGHDSDDEVIRAGDSSSDESDFTPTATQTKSGRHVNRPSLYMPTPASPAAIKENGNTLGGSDKLHEASRKRRRVFRKGKDANNITCVHCQRGHSPQSNAIVFCDECNRAWHQRCHDPPIENDVIAVKEKEWICLECKPVKISITHPTVVRSNPTLTSASLPPPVHTPPALPKIEVAGERFTADDQRRFLSGLSHATLVELLLAISDRNPTVPIFPEHLKTLPLSNFPFSHTIMTTTAATVLTPSPSVSTNTAPVTSTSNNSASTPSAETDKPSVEPASEPTGKKRHHYESSDDESEYDFQDHRLYPRAGNGIQLSTNPEDLDIMQEDPACPTFSYTLHKRAQA

SEQ ID NO: 81 - protein, 228 aa, Aspergillus clavatus
MALSRRLVWALSRHWSTICRIYSTTRTNPNLNNSDNNSTKKGPLSGVTVVGLEQAIAAPFCTRQLADLGARVIKIERPGVGDICAESYAYSSILAALFEREKDPARRGWSIDISMLECMVEWMGFLLYYAFEGQGGPKPAGASHAAIYPCGPFEAKQGIVMLGIQNEQEWANFCKIVLEESGLTIDECFCNNTLRPKIRVALKEIICGKLAQYSAEEVLKKFGYGWNC

SEQ ID NO: 82 - protein, 446 aa, Aspergillus nidulans
MNATFRLQRVLIAQRPSIQRSTRTNIFRHATQWRSYSSPLPPADGTLPLQGIRVLDMTRVLAGILGDLGAEVIKVEHPVRGDDTRAWGPPYAKYANDSKEGPGESAYYLAVNRNKKSIGLSFAHKSGVDILHKLVKECDVLVENYLPGSLKKYNMDYETLREINPSLIYASITGYGQTGPYSNRAGYDVMVEAEMGLMHITGSRGGDPVKVGVAVTDLTTGLYTSNAIMAALLARVRTGKGQHIDACLSDCQVATLSNIASSALISGQKDSGRWGTEHPSIVPYRSYQTLDGDILFGGGNDRLFGVLCDRLGHPEWKEDPRFLTNRDRVKHRAVIDGLIEDCVKQKTTQQWLEIMEGSGMPYAAVNDIQGTLNHEHVRARGMVTEIDHPACGPVKLVNTPIKYSHATPGVRTPPPTLGQHTDEVLGELLQYGEKQISQLKQDGVVS

SEQ ID NO: 83 - protein, 438 aa, Aspergillus terreus
MNVTLKLRRSVFAPALRRSGGLLRAQLRTPQWRPYSTAPADDTLPLKGVRVLDMTRVLAGVSYVIKVEHPVRGDDTRAWGPPYATYQDESRQGPGESAYYLAVNRNKKSIGLSFAHKSGVEILHRLAAQCDVLVENYLPGSLKKYNMDYETLREINPKLIYASITGYGQTGPYSNRAGYDVMVEAEMGLMHITGSRDGPPVKVGVAVTDLTTGLYTSNAIMAALLARARTGKGQHIDACLSDVQVATLANIASSALISGEKDSGRWGTEHPSIVPYRSYKTRDGNILFGGGNDRLFGVLCDRLGHPEWKEDPRFITNQDRVKHREDIDGMIEETAMQKTTQEWLEIMEGSGMPYAAVNDIQGTLNHAHVRARGMVTEVDHPACGPIKLVNTPIKYSHATPGVRTPPPTLGQHTNEILGEILDYGKEDIERLKEQGVVA

SEQ ID NO: 84 - protein, 361 aa, Aspergillus niger; identical to SEQ ID NO: 6

SEQ ID NO: 85 - protein, 361 aa, Aspergillus niger; identical to SEQ ID NO: 5

SEQ ID NO: 86 - protein, 379 aa, Aspergillus niger
MSLPSLARHSTRSLLRPQSLPPQLTRAFSNRPALRTSASASTIATTFLTRFQSLGPQARTQTLDANQLQLLSLTLNRPSLFPKSPSLSNTPTSLPTGTPLPAGYHLVYFTPAFLENELGADGTDTSYNPASPFTRRMWAGGEVHWPRGKDGKPNYLRVGQEVQETTRVLSAEPKVVRKTGEEMIVVGVEKEFRNEDGVAVLDRRRVGIVFCEVGNGADKNVYRNWVFRKALTSPSPTASSTPPATKAFNGPASSSTQTSDNVHTRTLRQTAVTLFRFSALTFNPHKIHYSTPWARDVEGHKDIVVHGPLNLISILDLWRDTRKNEGGELVLPEKISYRATSPLYAEEEYRIVLEDGGDGVGKVQIVAPGEVVAMKAEIQ

SEQ ID NO: 87 - protein, 1073 aa, Aspergillus kawachii
MSLPSLARHSTRPLLRPQSLPPQLTRAFSNRPALRTNTSASASSIATSFLTRFQSLGPQTRSQTLDANQLQLLSLTLNRPSLFPNSPSLSNTPTSLPTGTPLPAGYHLVYFTPAFLENELGADGTDTSYNPASPFTRRMWAGGEVHWPRGKDGKPNYLRVGQEVQETTRVLSAEPKVVRKTGEEMIVVGVEKEFRNEDGVAVLDRRNWVFRKALTSPSPTTSSTPPATKAFNGPASSSTQTSDNVHTRTLRQTAVTLFRFSALTFNPHKIHYSTLWARDVEGHKDIVVHGPLNLISILDLWRDTRKHEGGELVLPEKISYRATSPLYAEDEYRIVLEDGGDGVGRVQIVAPGEVVAMKAEIQLKCCRTHPCTNCLKRNEAGTCTFIGRGPRGKTSSNGRTSPTQVQDRLQHLENLILSFTQQQQQQQQQERSNSVGEHQQVINNGGQITPASSVQPSLAFGEVQQAQGGDSETPPPDPGRLVVRETGMRYIDGAHWSAILEEISGVKEYLRENEELGLSDEEGEDDEMVRPSNAPTLLLGLHQEMTMDELLDGLPARPVVDRVVAMFVGLNEPTTVMVHFPTFQKQYNQFWQRPKEVSISWLALLYAALTITMSVYMRTGEPLPAEFGEADEAVQRLRQLTAQCLVQSNYTVPGRFKVEALFFYTMCEFFRSEDAQVGVSFLLNMAIRLAMRSGYHRDPQHFPNITPYEGEMRRRVWAIMRQLDVLISFQVGVPRGIQDWQQDVELPRNISDEEFGESTVELPPSRPETELSTTAYIRGKSRLMAVFGKISDLAYSRDPMTYDDILALDRQLEEARDLVPTAFKIRPLDQCFVDSSYLILRRYTLELLYQKARCVLHRRYLGEVHTNPRYAYSRQVCMSASKEILRHQADIYHETQPGGLLYRDRQFPNSLQTADYLLAAMIICLDLSQNPTGTPTGSTDEDVAAVIRSREELLATIKTSHRIFEQQRRRSADAQKAYVALTIMLRRINFQQQESQQLTSAQPPLYGSWNGQPYSVGVDPMGITPEYQALDVIGEMLDAPTNLDWNLWDQQMQCAANTDVGLWGDNIPEAVNI

SEQ ID NO: 88 - protein, 362 aa, Aspergillus luchuensis
MSLPSLARHSTRPLLRPQSLPPQLTRAFSNRPALRTNTSASASSIATSFLTRFQSLGPQTRSQTLDANQLQLLSLTLNRPSLFPNSPSLSNTPTSLPTGTPLPAGYHLVYFTPAFLENELGADGTDTSYNPASPFTRRMWAGGEVHWPRGKDGKPNYLRVGQEVQETTRVLSAEPKVVRKTGEEMIVVGVEKEFRNEDGVAVLDRRNWVFRKALTSPSPTTSSTPPATKAFNGPASSSTQTSDNVHTRTLRQTAVTLFRFSALTFNPHKIHYSTLWARDVEGHKDIVVHGPLNLISILDLWRDTRKHEGGELVLPEKISYRATSPLYAEDEYRIVLEDGGDGVGRVQIVAPGEVVAMKAEIQ

SEQ ID NO: 89 - protein, 294 aa, Aspergillus flavus
MSLSSAVQGARHSNQNLFRGCSSFRRFSVHHCRRSVADSSATSIAASFLSRFQSLGPQTRSQFLDANQLQLLSLTLNRPSLYPDTPSLSNASTSIPAGTPLPPGYHLVYFTPAFLEDELGADGTDASYNPETPFTRRMWAGGEVHWPRAADGSPNPLLVGQEVQETTRVLSAEPKVVRKTGEEMIVVGVEKEFRNEHGVAVIDRRNWVFRKALAVPSVSSKTTNNPAPLPSAPASSSTVSTAKTHIRTLRQTAVTLFRFSALTFNPHKIHYVGAVQILAPGGQVAMKAEVRSAK

SEQ ID NO: 90 - protein, 385 aa, Aspergillus oryzae
MSLSSAVQGARHSNQNLFRGCSSFRRFSVHHCRRSVADSSATSIAASFLSRFQSLGPQTRSQFLDANQLQLLSLTLNRPSLYPDTPSLSNASTSIPAGTPLPPGYHLVYFTPAFLEDELGADGTDASYNPETPFTRRMWAGGEVHWPRAADGSPNPLLVGQEVQETTRVLSAEPKVVRKTGEEMIVVGVEKEFRNEHGVAVIDRRNWVFRKALAVPSVSSKTTNNPAPLPSAPASSSTVSTAKTHIRTLRQTAVTLFRFSALTFNPHKIHYSTPWAQQMEGHRDIVVHGPLNLISILDLWRDTRSNKSDPASMLPESITYRATSPLYAEDKYQIVLDEEEGLGVGAVQILAPGGQVAMKAEVRWRGNVKLLEILGYEDTSRFRAI

SEQ ID NO: 91 - protein, 294 aa, Aspergillus terreus
MSIHTSARWAMRSVPPLSQGCAALRRFSVQHACRSASEATAPSVAASFLSRFQSMGPQTRSQVLDANQLQGGEVQWPRGADGKPNPLRVGQEVQETTRVLSAEPKIIRKTGDEMIVVSVEKEFRNEHGVAVIDRRNWVFRKALTLASSPVSASPISVHLPALPASCSTSTVGKTHTRTLRQTAVTLFRFSALTFNPHKIHYSTPWARDVEGHKDIVVHGPLNLISILDLWRDTRADSATDSSLLLPESISYRATSPLYAEETYRIVLDEERGDSVSRVQIFTPDEKVAMKAEIR

SEQ ID NO: 92 - protein, 366 aa, Aspergillus flavus
MSLSSAVQGARHSNQNLFRGCSSFRRFSVHHCRRSVADSSATSIAASFLSRFQSLGPQTRSQFLDANQLQLLSLTLNRPSLYPDTPSLSNASTSILAGTPLPPGYHLVYFTPAFLEDELGADGTDASYNPETPFTRRMWAGGEVHWPRAADGSPNPLLVGQEVQETTRVLSAEPKVVRKTGEEMIVVGVEKEFRNEHGVAVIDRRNWVFRKALAVPSVSSKTTNNPAPLPSAPASSSTVSTAKTHIRTLRQTAVTLFRFSALTFNPHKIHYSTPWAQQMEGHRDIVVHGPLNLISILDLWRDTRSNKSDPASMLPESITYRATSPLYAEDKYQIVLDEEEGLGVGAVQILAPGGQVAMKAEVRSAK

SEQ ID NO: 93 - protein, 364 aa, Aspergillus terreus; identical to SEQ ID NO: 7

SEQ ID NO: 94 - protein, 358 aa, Aspergillus clavatus
MSVRPGLTQRCSTSRHFSVLHRRLCSQSDSASTIARSFLSRFQSLGPQTRIQILDSNQLQLLSLTLNRPSLFPNSPSLSHASASLQRGTPLPAGYHLVYFTPAFLETELGADGTDVSYNPEAPFTRRMWAGGEVQWPRGSDGKPNPLCVGQEVQETTRVLSAEPKVVRKTGEEMIVVGVEKEFRNDKGVAVLDRRNWVFRKAFPPSSTSKAADLLDPARPSGPATSTTAATGNTHTRTLKQTAVTLFRFSALTFNPHKIHYSLPWSRGVEGHKDIVVHGPLNLINILDLWRDTRVSATQHSELVLPQSISYRATSPLYAEEEYQIVLEDADNVSKVQILGPDGVTVAMKAEVRFESVA

SEQ ID NO: 95 - protein, 365 aa, Aspergillus nomius
MSLSSTVQWARYSNQNLFRGCSSFRRFSVHHGRCSAADSSASATAASFLSRFQSLGPQTRSQFLDANQLQLLSLTLNRPSLYPDTPSLSHASTSLPAGTPLPPGYHLVYFTPAFLENELGADGTDVSYNPETPFTRRMWAGGEVHWPRAADGSPNPLRVGQEVQETTKVLSAEPKIVRKTGEEMIVVGVEKEFRNEHGVAVIDRRNWVFRKALAVPSVSSTASDPAPLPSAPASSSTVSAAKTHTRTLRQTAVTLFRFSALTFNPHKIHYSTPWAQQMEGHRDLVVHGPLNLISILDLWRDTRPNTADPASMLPESITYRATSPLYAEDEYQIVLDEEEGSGIGTVQIIAPGGTVAMKAEVRSAE

SEQ ID NO: 96 - protein, 364 aa, Aspergillus lentulus
MSVRSRLACQSGRFVSKGYTPSARQFSTHGQRCSPSDSASSIAASFLSRFNSLGPQTRTQVIDSNQLQLLSLTLNRPTLYPNSPVFTNASASLQQGTPLPAGYHLVYFTPAFLESELGADGTDVSYNPETPFTRRMWAGGEVQWPRGPDGMPNPLRVGQEIQETTRVLSAEPKTVRRTGEEMIVVGVEKEFRNEHGVAVLDRRNWVFRKALAPSSSSVSTNLLDPITPSGPAFSKTSTTGSVHTRTMKQTAVTLFRFSALTFNPHKIHYSLPWARDVEGHRDIVVHGPLNLINILDLWRDTRASTLASESPELILPQSISYRATSPLYAEEEYRIVLEDEDSIAKVQVIGPDGMTVAMKAEIKS

SEQ ID NO: 97 - protein, 353 aa, Aspergillus ruber
MLFLRPTLRTAHFLYRKRLFSTSPGKTSASSIAFSFLERFQSLGPQIRTQALDANQLQLLTFTLNRPSLYPNISSLSNNTTPPPAGTPLPPGYHLVYFTPAFLENELGADGTDVSYNPASPFTRRMWAGGEVQWPRGIKGRVNPLRVGQEVTETTRVLSAEPKVVKKTGEEMIVVSVEKEFRNEEGVAVLDRRNWVFRKALPIPSTASSSTTPSSQQWTPPQPASCITTTSGSTHTRTLRQTPVTLFRFSALTFNPHKIHYSVPWARDVEGHKDIVVHGPLNLISILDLWRDTRSQNTEAGLEALVPESIKYRATSPLYAEDEYRIVLEESDGVGNVQILAPGDVVGMKAEIS

SEQ ID NO: 98 - protein, 373 aa, Aspergillus fischeri
MSVRTRLACQSRRFVSKGYTPSARQFSTHGQRCSQSDSASSIAASFLSRFNSLGPQTRTQVLDSNQLQLLSLTLNRPTVYPNSPVLTNASASLQQGTPLPAGYHLVYFTPTFLESELGADGTDVSYNPETPFTRRMWAGGEVQWPRGPDGMPNPLRVGQEIQETTRVLSAELKIVRRTGEEMIVVGVEKEFRNEHGDTVNGNRTWRTTNGTRNWVFRKALAPSSSSVSTNLPDPITPSGPAFSKTSTTGNVHTRTMKQTAVTLFRFSALTFNPHKIHYSLPWARDVEGHRDIVVHGPLNLINILDLWRDTRTSTLASEAPELILPQSISYRATSPLYAEEEYRIVLEDEDSIAKVQVIGPDGMTIAMKAEIKG

SEQ ID NO: 99 - protein, 364 aa, Aspergillus fumigatus
MSVRTRLACQSRRFVSKGYTRSARQFSAHGQRCSQSDSASSIAASFLSRFNSLGPQTRTQVLDSNQLLLLSLTLNRPTLHPNSPVLTTASGSLQQGTPLPAGYHLVYFTPTFLETELGADGTDVSYNPDTPFTRRMWAGGEVQWPRGPDGMPNPLRVGQEIQETTRVLSAEPKIVRRTGEEMIVVGVEKEFRNEHGVAVLDRRNWVFRKALSPSSAAASTNLPDPITPSGPAFSKTSTIGNVHTRTMKQTAVTLFRFSALTFNPHKIHYSLPWARDVEGHRDIVVHGPLNLINILDLWRDTRTATLASEAPELILPQSISYRATSPLYAEEEYRIILEDEDSIAKVQVIGPDGKTVAMKADIKS

SEQ ID NO: 100 - protein, 374 aa, Aspergillus nidulans
MLISRPVTRGTTRTLPTRLIPLACLRFSSSTSDASASSIATSFLSRFQSLGPQTRTQTLDANQLRLLSLTLNRPSLLPTTPHLSQLATASNQCEIEVANGTPLPAGYHLAYFTPAFLENELGADGTDTSYNPAHPFTRRMWAGGEVCWPRDSNGSVNPLRVGEKVTETTRVLSAEAKTVRKTGEEMIVVGVEKEFSNEAGVAVIDRRNWVFRKALPPPSIQQTQDLPPPTPPSSLPATSTTTSSPDGLTHTRTLRQTAVTLFRFSALTFNPHKIHYSLPWARDVEGHRDIVVHGPLNLINILDLWRDTRTATLASEAPELILPQSISYRATSPLYAEEEYRIILEDEDSDGKKSAVEIITPEGNVGMKAEVVGV

SEQ ID NO: 101 - protein, 341 aa, Aspergillus udagawae
MSVGTRLAFQSGRFLSKGYTASARQFSTHGLLCSQSDSASSIAASFLACFNSLGPQTRTQVLDSNQLQLLSLTLNRPTLYPNSPVLTNASASLPQGIPLPAGYHLVYFTPAFLESELGADGTDVSYNPETPFTRRQEIQETTRVLSADPKIVRRTGEEMIVVGVEKEFRNEHGVAVLDRRNWVFRKALSTSSSSVSTNLPDPITPSGPAFSKTSTTSNVHTRTMKQTAVSLFRFSALTFNPHKIHYSLPWARDVEGHRDIVVHGPLNLINILDLWRDTRTSTLISEGPELILPQSISYRATSPLYAEEEYRIVLEDQDGVANVQVIGPDGMTVAMKAEIKS

SEQ ID NO: 102 - protein, 343 aa, Aspergillus fumigatus
MNRSRRFVSKGYTRSARQFSAHGQRCSQSDSASSIAASFLSRFNSLGPQTRTQVLDSNQLLLLSLTLNRPTLHPNSPVLTTASGSLQQGTPLPAGYHLVYFTPTFLETELGADGTDVSYNPDTPFTRRMWAGGEVQWPRGPDGMPNPLRVGQEIQETTRVLSAEPKIVRRTGEEMIVVGVEKEFRNEHGVAVLDRRNWVFRKALSPSSAAASTNLPDPITPSGPAFSKTSTIGNVHTRTMKQTAVTLFRFSALTFNPHKIHYSLPWARDVEGHRDIVVHGPLNLINILDLWRDTRTATLASEAPELILPQSISYRATSPLYAEEEYRIILEEASTGQGSLILR

SEQ ID NO: 103 - protein, 372 aa, Aspergillus calidoustus
MTMLLTTATRPSRLLTKHLRNLRFSSSSSTSASTIASSFLNRFQSLGPQIRTQTLDPNQLRLLSLTLNRSSLFPSLPALSSTTTTPTADNAIDTEVSAGTPLPPGYHLVYFTPAFLETELGADGTDTSYNPSHPFTRRMWAGGEVSWPRDGSGRANPLRVGQRVTETTRVLSAEPKVVRKTGEEMIVVGVEKEFANEGGVAVVDRRNWVFRKALPPLTPSTTAEASSTLPPPSPPTPHPATSTTTSTGNTHTRTLTQTAVTLFRFSALTFNPHKIHYSLPWARDVEGHRDIVVHGPLNLISILDLWRDLRGADGRDGSLDLLYPESISYRATSPLYAGDEYRIVLEEKEGKGVVEILTADGRTAMKAGITSV

SEQ ID NO: 104 - protein, 378 aa, Aspergillus ustus
MLLTATIRPSRPLTKHLRGLRFSSSSSSSASASASASAIAASFLDRFQSLGPQIRTQTLDPNQLRLLSLTLNRPSLFPSSSPLSSTTTDAPAANVAGTEIAAGTPLPPGYHLVYFTPAFLETELGSDGTDTSYNPSHPFTRRMWAGGEVSWQRDASGGAVNPLRVGQKVTETTRVLSAEPKIVKKTGEEMIVVGVEKEFANEGGVAVVDRRNWVFRKALPPPTSSTTASSSSTLPPASPPTPHPASCTTISSGNTHTRTLSQTAVTLFRFSALTFNPHKIHYSLPWARDVEGHRDIVVHGPLNLISILDLWRDLRGADGSDGSLDTLYPEKISYRATSPLYAGDEYRIVLEEGQGKKGIVEILTPEGTIGMKAEIVGV

SEQ ID NO: 105 - protein, 322 aa, Aspergillus niger; identical to SEQ ID NO: 9

SEQ ID NO: 106 - protein, 323 aa, Aspergillus niger; identical to SEQ ID NO: 8

SEQ ID NO: 107 - protein, 324 aa, Aspergillus niger
MAARNTLRRALLYIPGSSQRFIDKSRTLTADCVAYDLEDSVTPHKKAEARSLVRRALDEPAPQGIRERAVRINSVDSGLALGDLTEVLKSPNLTTIVIPKVNTPSDLTFVNDVITHTLSQQQQTQDPSTPRTPISLLALVESAKSLTNLTQICASTPLLQGLIFAAEDFALDLSITRTPSLTEFLFARSMIATAARAANLPSTIDLVCTAYKSTKGDGSPPAVLEEECRDGRRLGFNGKQCIHPSQVETAQAIFGPDPEEVKWAVRVCVADEKAARAGRGAWTLDGKMIDVPVAEKARAVVRKAEACGFDVGGLREEWGHQEPE

SEQ ID NO: 108 - protein, 324 aa, Aspergillus kawachii
MAARNTLRRALLYIPGSSQRFIDKSRTLTADCVAYDLEDSVTPHKKAEARSLVRRALDEPAPQGIRERAVRINSVDSGLALGDLTEVLKSPNLTTIVIPKVNTPSDLTFVNDVITHTLSQQQQTQDPSTPRTPISLLTLVESAKSLTNLTQICASTPLLQGLIFAAEDFALDLSITRTPSLTEFLFARSMIATAARAANLPSTIDLVCTAYKSTKGDGSPPAVLEEECRDGRRLGFNGKQCIHPSQVETAQAIFGPDPEEVKWAVRVCVADEKAARAGRGAWTLDGKMIDVPVAEKARAVVRKAEACGFDVGGLREEWGHQEPE

SEQ ID NO: 109 - protein, 323 aa, Aspergillus oryzae
MASRNALRRALLYIPGSSQRFIDKSRTLTADCVAYDLEDSVTPHKKAEARSLVRRALDQPAPSGIRERAVRINSVDSGLALADLTEVLQSPNLSTVVIPKVNSASDLTFVNDVITHTLSQQPQSQDASSRPPISLLALVESAKSLTNLTQICASTPLLQGLIFAAEDFALDLSLTRTPDLTEFLFARSMIATAARAANLPSTIDLVCTTYKSTKGDGSPPAVLEEECRGGRQLGFNGKQCIHPSQVPTVQQIFGPDSDEVQWAVRVTIADDKAAAAGRGAWTLDGKMIDVPVAEKARAIVKKAEACGFNVEELREKWRDQEPE

SEQ ID NO: 110 - protein, 322 aa, Aspergillus fischeri
MASRNTLRRALLYIPGSSQRFIDKSRSLTADCVAYDLEDSVTPHKKAEARSLVRALDQPAPSGIRERAVRINSVDSGLALADLTEVLQSPNLSTIVIPKVNSASDLTFVTDVVSHTLSQQAHSQDAASRPPISLLALVESAKSLTNLTQICAATPLLQGLIFAAEDFALDLSLTRTPSLTEFLFARSAIVTAARAANLPSTIDLVCTAYKSTKGDGSPPAALEEECRGGKQLGFNGKQCIHPSQVETAQRIFGPEPAEVEWAVRVTIADEKAAKAGRGAWTLDGKMIDIPVAEKARAIVKKAEACGFDVKELQDKWQHQEPE

SEQ ID NO: 111 - protein, 323 aa, Aspergillus clavatus
MASRNTLRRALLYIPGSSQRFIDKSRSLTADCVAYDLEDSVTPYKKAEARSLVRRALDQPAPSGIRERAVRINSVDSGLALADLTEVLQSPNLSTIVIPKVNSASDLTFVTDVITHTISQKSQTQDGHPRPPISLLALVESAKSLTNLTQICAATPLLQGLIFAAEDFALDLSLTRTPSLMEFLFARSAIVTAARAANLPSTIDLVCTAYKSTKGDGSPPAVLEEECRSGKQLGFNGKQCIHPSQVETAQRIYGPETDEVQWAVRVVIADEKAAQAGRGAWTLDGKMIDIPVAEKARSIVKKAEACGFDVRELREKWQHQEPE

SEQ ID NO: 112 - protein, 323 aa, Aspergillus lentulus
MASRNTLRRALLYIPGSSQRFIDKSRSLTADCVAYDLEDSVTPHKKAEARSLVRRALDQPAPSGIRERAVRINSVDSGLALADLTEVLQSPNLSTIVIPKVNSASDLTFVTDVISHTLSQQAHSQDAAARPPISLLALVESAKSLTNLTQICAATPLLQGLIFAAEDFALDLSLTRTPSLTEFLFARSAIVTAARAANLPSAIDLVCTAYKSTKGDGSPPAVLEEECRGGKQLGFNGKQCIHPSQVETAQRIFGPEPAEVEWAVRVTIADEKAAKAGRGAWTLDGKMIDIPVAEKARAIVKKAQACGFDVEELQDKWRHQEPE

SEQ ID NO: 113 - protein, 323 aa, Aspergillus flavus
MASRNALRRALLYIPGSSQRFIDKSRTLTADCVAYDLEDSVTPHKKAEARSLVRRALDQPAPSGIRERAVRINSVDSGLALADLTEVLQSPNLSTVVIPKVNSASDLTFVNDVITHTLSQQPQSQDASSRPPISLLALVESAKSLTNLTQICASTPLLQGLIFAAEDFALDLSLTRTPDLTEFLFARSMIATAARAANLPSTIDLVCTTYKSTKGDGSPPAVLEEECRGGRQLGFNGKQCIHPSQVPTVQQIFGPDSDEVQWAVRVTIADDKAAAVGRGAWTLDGKMIDVPVAEKARAIVKKAEACGFNVEELREKWRDQEPE

SEQ ID NO: 114 - protein, 323 aa, Aspergillus udagawae
MASRNTLRRALLYIPGSSQRFIDKSRSLTADCVAYDLEDSVTPHKKAEARSLVRRALDQPAPSGIRERTVRINSVDSGLALADLTEVLQSPNLSTIVIPKVNSASDLTFVTDVISHTLSQQPHSQDAASRPPISLLALVESAKSLTNLTQICAATPLLQGLIFAAEDFALDLSLTRTPSLTEFLFARSAIVTAARAANLPSTIDLVCTAYKSTKGDGSPPAVLEEECRGGKQMGFNGKQCIHPSQVETVQRIFGPEPAEVQWAVRVTIADEKAAKAGRGAWTLDGKMIDIPVAEKARAIVKKAEACGFDVEELQDKWRHQEPE

SEQ ID NO: 115 - protein, 323 aa, Aspergillus parasiticus
MASRNALRRALLYIPGSSQRFIDKSRTLTADCVAYDLEDSVTPHKKAEARSLVRRALDQPAPSGIRERAVRINSVDSGLALADLTEVLQSPNLSTIVIPKVNSASDLTFVNDVITHTLSQQPQSHDASSRPPISLLALVESAKSLTNLTQICASTPLLQGLIFAAEDFALDLSLTRTPDLTEFLFARSMIATAARAANLPSTIDLVCTTYKSTKGDGSPPAVLEEECRGGRQLGFNGKQCIHPSQVPTVQQIFGPDSDEVQWAVRVTIADDKAAAAGRGAWTLDGKMIDVPVAEKARAIVKKAVACGFNVEELREKWRDQEPE

SEQ ID NO: 116 - protein, 323 aa, Aspergillus fumigatus
MASRNTLRRALLYIPGSSQRFIDKSRSLTADCVAYDLEDSVTPHKKAEARSLVRRALDLPAPSGIRERAVRINSVDSGLALADLTEVLQSPNLSTIVIPKVNSASDLTFVTDVVSHTLSQQARSQDAASRPPLSLLALVESAKSLTNLTQICAATPLLQGLIFAAEDFALDLSLTRTPSLTEFLFARSAIVTAARAANLPSTIDLVCTAYKSTKSDGSPPAALEEECRGGKQLGFNGKQCIHPSQVETAQRIFGPEPAEVEWAVRVTIADEKAAKAGRGAWTLDGKMIDIPVAEKARAIVKKAGACGFNVKELQDKWQHQEPE

SEQ ID NO: 117 - protein, 327 aa, Aspergillus fumigatus
MLFTMASRNTLRRALLYIPGSSQRFIDKSRSLTADCVAYDLEDSVTPHKKAEARSLVRRALDLPAPSGIRERAVRINSVDSGLALADLTEVLQSPNLSTIVIPKVNSASDLTFVTDVVSHTLSQQARSQDAASRPPLSLLALVESAKSLTNLTQICAATPLLQGLIFAAEDFALDLSLTRTPSLTEFLFARSAIVTAARAANLPSTIDLVCTAYKSTKSDGSPPAALEEECRGGKQLGFNGKQCIHPSQVETAQRIFGPEPAEVEWAVRVTIADEKAAKAGRGAWTLDGKMIDIPVAEKARAIVKKAGACGFNVKELQDKWQHQEPE

SEQ ID NO: 118 - protein, 330 aa, Aspergillus rambelli
MASRNALRRALLYIPGSSQRFIDKSRTLSVDCVAYDLEDSVAPHMKAEARSLVRRALDQPVPAGIRERAVRINSVNSGLALSDLTEVLKSPNLTTIVIPKVNSASDLTFVTDVINHTLSQSQAPPQSQAEADALASRPPISLLALVESAKSLTNLTHICSATPLLQGLIFAAEDFALDLSLTRTPALTEFLFARSAIVTAARAADLPSTIDLVCTTYKSTKADGSPPAVLEEECRGGRGLGFNGKQCIHPSQVETVQAIYGPDPEEVQWAVRTAIADEKAARAGRGAWTLDGKMIDVPVAAKARAIVKRAEACGFNVGELREKWKGQEPA

SEQ ID NO: 119 - protein, 330 aa, Aspergillus ochraceus; identical to SEQ ID NO: 118

SEQ ID NO: 120 - protein, 349 aa, Aspergillus nomius
LNRSVSSDNGVQKYAPSRIALQRTTSLTPRRPSLTLNNPVPGSSQRFIDKSRTLTADCVAYDLEDSVTPHKKAEARSLVRRALDQPAPSGIRERAVRINSVDSGLALADLTEVLQSPNLSTIVIPKVNSASDLTFVNDVITHTLSQQPQSQDASSRPPISLLALVESAKSLTNLTQICASTPLLQGLIFAAEDFALDLSLTRTPDLTEFLFARSMIATAARAANLPSTIDLVCTTYKSDKADGSPPAVLQQECRDGKNLGFNGKQCIHPSQVSTVQQIFGPELEEVQWAVRVTIADDKAAKAGRGAWTLDGKMIDVPVAEKARAIVKKAEACGFNVEELREKWRDQEPE

SEQ ID NO: 121 - protein, 327 aa, Aspergillus ruber
MATRNALRRSLLYIPGSSQRFIDKSRTLSADCIAYDLEDSVTPHKKIEARGLVRRALDQPAPEGIRERAVRINSVDSGLALGDLTEVLQSPNLSTIVLPKVNSPSDLTFVTDVISHTLSQQQQQQQQHQQVQQRPPVSLLALVESAKSLTNLTQICSASPLLQGLIFAAEDFALDLSLTRTPALTEFLFARSMIATAARAANLPSTIDLVCTAYKSTTGDGRPPAALEEECRGGKHLGFNGKQCIHPSQVETVERIFGPEDKEVEWAVRVKIADEQAAAAGRGAWTLDGKMIDVPVAEKARAIVKKAEACGFNVHELREKWQHQEPE

SEQ ID NO: 122 - protein, 322 aa, Aspergillus terreus; identical to SEQ ID NO: 10

SEQ ID NO: 123 - protein, 322 aa, Aspergillus terreus
MASRNTLRRALLYIPGSSQRFIDKSRTLTADCVAYDLEDSVTPHKKAEARSLVRRALDQPAPAGILERAVRINSVDSGLALADLTEVLQSPNLSTIVIPKVNSASDLTFVTDVITHTLSQLPLSQSASRPPISLLALVESAKSLTNLSQICAASPLLQGLIFAAEDFALDLSLTRTPALTEFLFARSAIATAARAANLPSTIDLVCTTYKSDKGDGSPPVVLQQECRDGKNLGFNGKQCIHPSQVSTVQQIFGPELEEVQWAVRVTIADDKASKAGRGAWTLDGKMIDIPVAEKARAIVKKADACGFNVQELREKWQHQEPE

SEQ ID NO: 124 - protein, 325 aa, Aspergillus calidoustus
MAARNTLRRALLYIPGSSQRFIDKSRSLAADCVAYDLEDSVTPHKKAEARSLVRRALDEPAPASIRERAVRINSVDSGLALADLTEVLKSPNLSTIVIPKVNSASDLTFVTDVIHHTLAQQATQAQSPQQERPPISLLALIESAKSITNLPQITAATPYLQGLIFAAEDFALDLSLTRTPSLTEFLFARSAIATAARAANLPSTIDLVCTTYKSDKGDGSPPAVLEDECRGGRGLGFNGKQCIHPSQVETVQRIYGPDVEEVTWAVRVVIADEKAARAGRGAWTLDGKMIDVPVAEKAKSIVKKAEACDFDVAALKKKWRDQEPE

SEQ ID NO: 125 - protein, 283 aa, Aspergillus nidulans
MAARNTLRRALLYIPGSSQRFITKSRSLTADCVAYDLEDSVTPHKKAEARSLVRRALDEPAPPSIRERAVRINSVDSGLALADLTEVLKSPNLSTIVIPKVNSASDLTFVNDVITHTLAQQEAQGLPVTKSPISLLALVESAKSLTNLTSITSATPLLQGLIFAAEDFALDLSLTRTPSLTEFLFARSAIATAARAANLPSTIDLVCTTYKSNSGDGKPPAQLEEECRGGRGLGFNGKQCIHPSQVETVQRIYGPDEEEVNWAIRVVVADEKAARQGRGAWTL

SEQ ID NO: 126 - protein, 264 aa, Aspergillus niger; identical to SEQ ID NO: 12

SEQ ID NO: 127 - protein, 286 aa, Aspergillus niger; identical to SEQ ID NO: 11

SEQ ID NO: 128 - protein, 334 aa, Aspergillus niger
MFRPRLPLSPHRFSHLRSHPAKTSDWSATQYLKFADERAIPTQDLLSHIPLQSPSHIVDLGCGPGNSTAMLSARYPSCPSISGIDSSPNMIARAKESSNNNTTFAVADVETYSPPPNQPVDLFFSNAVLHWLPRSTRLPTIRRLLLALPPGGVFAFQVPDTLNEPSHTSMREVARTGPWAEHLRGTLVERDELDSPGEIYDALVDCCESLRIWESVYYHSLGSWGEIVEWVKGTGLRPYLDGLRGEEERGEFLKVYEEKLREKYEKRADGRCIGRGQNVGCSDHVIQASGVYGMHACWYNPKFIVRIWNRSSGPFSPEISPALDHSPDAIKIEC

SEQ ID NO: 129 - protein, 288 aa, Aspergillus kawachii
MFRPRLSLTPQRITQLLTHPAKMSDWSATQYLKFADERAIPTQDLLSHIPLQSPSHIVDLGCGPGNSTAMLSARYPSCPSIAGIDSSPNMIARAKESSTSTSNTTFAVADVESYSPPPDHPVDLFFSNAVLHWLPRSTRLPTIRRLLLTLPPGGVFAFQVPDTLNLPSHTSMREVARTGPWAEHLRSALVERDELDSPEEIYDALVDVCENLRIWETVYYHSLGDWRDIVEWVKGTGLRPYLDGLRGEEERKEFLRVYEGLLRERYEKRADGRVMLRYPRLFVVAVRK

SEQ ID NO: 130 - protein, 266 aa, Aspergillus luchuensis
MSDWSATQYLKFADERAIPTQDLLSHIPLQSPSHIVDLGCGPGNSTAMLSARYPSCPSIAGIDSSPNMIARAKESSTSTSNTTFAVADVESYSPPPDHPVDLFFSNAVLHWLPRSTRLPTIRRLLLTLPPGGVFAFQVPDTLNLPSHTSMREVARTGPWAEHLRSALVERDELDSPEEIYDALVDVCENLRIWETVYYHSLGDWRDIVEWVKGTGLRPYLDGLRGEEERKEFLRVYEGLLRERYEKRADGRVMLRYPRLFVVAVRK

SEQ ID NO: 131 - protein, 266 aa, Aspergillus niger
MSDWSATQYLKFADERAIPTQDLLSHIPLQSPSHIVDLGCGPGNSTAMLSARYPSCPSIAGIDSSPNMIARAKESSTSTSNTTFAVADVESYSPPPDHPVDLFFSNAVLHWLPRSTRLPTIRRLLLTLPPGGVFAFQVPDTLNLPSHTSMREVARTGSWAEHLRSTLVERDELDTPEEIYDALVDVCESLRIWETVYYHSLGDWRDIVEWVKGTGLRPYLDGLRGEEERNEFLRVYEGLLKEKYEKRADGRVMLRYPRLFVVAVRK

SEQ ID NO: 132 - protein, 265 aa, Aspergillus terreus; identical to SEQ ID NO: 13

SEQ ID NO: 133 - protein, 259 aa, Aspergillus flavus
MSKNDWSATQYLKFEDERTMPARDLLARVPLQAPRRVVDLGCGPGNSTAVLATRYPDAHIVGMDSSPDMIQKAKATLPAYEFSVEDLRSYSPPPSVDLFFSNAVFQWLKKEERIPVIKGLMETQPSGGVFAFQVPDNLMEPSHVLMREVASNGPWASTLSNVGRDTFQSPQEIYDQLKDLSSEVNIFRTAYHHSLENHSAIVEWVKGTGLRPYVDPLSPQDKEAFLSEYLKRLESAYPKLIDGRVLLPYPRLFVVAVRK

SEQ ID NO: 134 - protein, 295 aa, Aspergillus oryzae
MFTYTQSLFTRSALLSGKSSLTQLSHHRALSFSSRVMSKNDWSATQYLKFEDERTMPARDLLARVPLQAPRRVVDLGCGPGNSTAVLATRYPDAHIVGMDSSPDMIQKAKATLPAYEFSVEDLRSYSPPPSVDLFFSNAVFQWLKKEERIPVIKGLMETQPSGGVFAFQVPDNLMEPSHVLMREVASNGPWASTLSNVGRDTFQSPQEIYDQLKDLSSEVNIFRTAYHHSLENHSAIVEWVKGTGLRPYVDPLSPQDKEAFLSEYLKRLESAYPKLIDGRVLLPYPRLFVVAVRK

SEQ ID NO: 135 - protein, 259 aa, Aspergillus nomius
MSTNDWSATQYLKFEDERTMPARDLLARVPLQAPRRIVDLGCGPGNSTAVLATRYPDAHIVGMDSSPDMIQKAKSSLPAYEFSVEDLRSYSPPPSVDLFFSNAVFQWLKKEERIVVIKGLMETQPSGGVFAFQVPDNLMEPSHVLMREVAINGPWASTLSNVGRDTFQSPQEIYDQLKDLSSEVNIFRTEYYHSLEDHKAIVEWVKGTGLRPYVDPLSLQDKEAFLSDYLKRLESAYPKLIDGRVLLPYPRLFVVAVRK

SEQ ID NO: 136 - protein, 259 aa, Aspergillus parasiticus
MSKNDWSATQYLKFEDERTMPARDLLARVPLQAPRRVVDLGCGPGNSTAVLATRYPDAHIVGMDSSPDMIQKAKATLPAYEFSVEDLRSYSPPPSVDLFFSNAVFQWLKKEERITVIRGLMETQPAGGVFAFQVPDNLMEPSHVLMREVASNGPWASTLSNVSRDTFQSPQEIYDQLKDLSSEVNIFRTAYYHSLENHRAIVEWVKGTGLRPYVDPLSPQDKEAFLSQYLKRLESAYPNLIDGRVLLPYPRLFVVAVRK

SEQ ID NO: 137 - protein, 288 aa, Aspergillus rambelli
MLPVPIPKALSGLLPPGSFRRGFHRSRINMATKDWSAQQYLKFEAERTRPSRDLLAQVPLKSPKRIVDLGCGPGNSTAVLLSRYPGSHVTGIDSSPDMIRKARSAIPNIEFTVQDLRAYSPDEPVDLFFSNAVFQWLSRSDRISVMKKLIQSQPSGGVFAFQVPDNLMEPSHAAMRETAADGPWAKTLSTAARDTFQSPQEIYDELQPLCSAVNMWHTHYYHSLEGHEAVMEWVKGTGLRPFIDPLSPADRDAFLKDYLSRLEKLYPKSVDGRVLLRYPRLFVVAVRE

SEQ ID NO: 138 - protein, 288 aa, Aspergillus ochraceus
MLPVPIPKALSGLLPPGSFRRGFHRSRINMATKDWSAQQYLKFEAERTRPSRDLLAQVPLKSPKRIVDLGCGPGNSTAVLLSRYPGSHVTGIDSSPDMIRKARSAIPNIEFTVQDLTAYSPDEPVDLFFSNAVFQWLSRSDRISVMKKLIQSQPSGGVFAFQVPDNLMEPSHAAMRETAADGPWAKTLSTAARDTFQSPQEIYDELQPLCSAVNMWHTHYYHSLEGHEAVMEWVKGTGLRPFIDPLSPADRDAFLKDYLSRLEKLYPKSVDGRVLLRYPRLFVVAVRE

SEQ ID NO: 139 - protein, 284 aa, Aspergilluscalidoustus
MLFSSRTTSHLLPRALTVRHFPTRTMATKDWSAQQYLKFEAERTRPSRDLLSQIPLKSPKRVVDLGCGPGNSTAVLLKQYPDAHLTGMDSSPDMIRKASATLPNIEFTVEDLNTYTPQEPVDVFFSNAVFQWIPRKERLEVVKRLIRSQPSGGVFAFQVPDNLTEPSHAAMQETAANGPWAEALSTVGRDTFQSPQEIYDELKPLCSDVNVWHTHYYHSLENHEAVVEWVKGTGLRPYIDPLSATDRESFLEAYLGRLEKLYPKTIDGRVLLRYPRLFVVAVRA

SEQ ID NO: 140 - protein, 259 aa, Aspergillus ruber
MAQADWSASQYLKFMNERTTPARDLLARVPLQDPETIVDLGCGPGNSTAVLAHRYPNAHLVGMDSSPDMIKKAQSTLPSLEFTVEDLRTYSPPQSVDLFFSNAVLHWLGRDERIALIKRLMESQPSGGVFAFQVPYNLTEPSHVLMKEVAADGPWASTLKNTGRDAFQTPREIYDQLIPMSSEVHIFKTDYHHPLEDHRAIIEWVQGTGLRPYLDPLSPEEKEAFINEYLKRLESVYPKSVDGRVLLGYPRLFVVAVKK

SEQ ID NO: 141 - protein, 333 aa, Aspergillus nidulans
MSFTARSLRQVLTSTSRNFHCSRTMAASDWSARQYLKFEAERTRPARDLLAQVPLDSPHRVVDLGCGPGNSTAVLVSRYPDARVTGMDSSPDMIGKARETLPGIEFTVDGLSTYTPREPVDLFFSNAVFQWLPRDQRLEIIKRLIQSQPSGGVFAFQVPDNLAEPSHVTMREIAANGPWSSTLQSVARESFQSPHELYDELKPLCAEVNIWHTYYNHSLENHKAVVEWVKGTGLRPFIDPLSQPDRESFLKAYLGRLEQLYPNSRLQPFGSWQEQLCHTASPAHYPPPALVLVAVLHIVHIAEIPTLFNVSILALPLRRPWFEISLPLQQSLS

SEQ ID NO: 142 - protein, 678 aa, Aspergillus nidulans
MSFTARSLRQVLTSTSRNFHCSRTMAASDWSARQYLKFEAERTRPARDLLAQVPLDSPHRVVDLGCGPGNSTAVLVSRYPDARVTGMDSSPDMIGKARETLPGIEFTVDGLSTYTPREPVDLFFSNAVFQWLPRDQRLEIIKRLIQSQPSGGVFAFQVPDNLAEPSHVTMREIAANGPWSSTLQSVARESFQSPHELYDELKPLCAEVNIWHTYYNHSLENHKAVVEWVKGTGLRPFIDPLSQPDRESFLKAYLGRLEQLYPNSRLQPFGSWQEQLCHTASPAHYPPPALVLVAVLHIVHIAEIPTLFNVSILALPLRRPWFEISLPLQQSLSVCLTMLPWVHPHLAQSVNPDKGRQLQAAQSIQRGEVLLIDPPYAIIPISDVDATTSLRKAICSNPQCNKPVSRDTASRCPNRCNNDVFWCNDSCEETDKARHDFECTWLAKYTTSLLSKWGEYNFGMLWLIVRILSRRYTESSYPHNIEDKPPAHDSHPSLSRFKFGWPAIDSLCGTPETWSHAQVREWTVLVKKYLGSSTLPHDLSNSDVLALICKEEANSFGLYPRETGVFPPPNPPVSRGEQFAAAVYPRASIANHSCCPNIIHKPDKVGRMVFTAGRDIAAGEECCISYFDMTQYVSLQDRRRHLQGLFRFKCGCPRCLEEETAAADTANETHWDAFPGFA

SEQ ID NO: 143 - protein, 272 aa, Aspergillus ruber
MSSTKDQWSAEAYSASASFVPKLTQKLLSYLVPQPTDKILDVGCGDGKFTANFLPAVGSVLGIDSSPAMIESAKKDYGNEKAEWRVVDCRYLDKEEAIVNGSWDKVISNAALHWILRDSSTRMDTLRAIHGSLKPGGTFVFEMGGHGNVPEVMTALIYTLVQHGVPAEKAKAANPWFFPSEVWMKNALESIGFHVDQMEIEFRPTKLTADANGGLAGWIKLMGAPFLDVLPGEKQDDAVKQICDILEPVVTREEDGSQWLGYVRLRGISKKI

SEQ ID NO: 144 - protein, 493 aa, Ustilago maydis
  misc_feature (3)..(26): Xaa can be any naturally occurring amino acid
  misc_feature (34)..(52): Xaa can be any naturally occurring amino acid
  misc_feature (491)..(493): Xaa can be any naturally occurring amino acid
MAXXXXXXXXXXXXXXXXXXXXXXXXMSSMASRXXXXXXXXXXXXXXXXXXXTLSDIFGTPQMREIWSDQNRVACYLEIEAALAIVQADLGIIPKNAAHEIVEHCRVQEIDWALYKQKTELIGYPVLGIVQQLVANCKDGLGEYCHWGATTQDITDTATVMQIRQSLTLVKQRLDSIVSSLEHLAEQHRNVPMAARSNLKQAVPITFGFKMARFLATFRRHQQRLVELEKRVYTLEFGGAAGNLSSLGDQGIATHDALAKMLDLAPAEIAWHTEHDRFAEVGTFLGLLTGTLAKLATDIKLMSQTEVGEVGEPFISNRGSSSTMPQKNNPISCVYIHACAANVRQGAAALLDAMQSDHERGTGPWEIIWVQLPLMMNWTSAALNNADFVLRGLQVFPDAMQHNLDLSKGLIVSEAVMMGLGNTLGRQYAHDAVYECCRTAFVQDRPLLDVLLENHEIASKLDRTELEKLCDPANYLGQCSQWIDRVLSRPXXX

SEQ ID NO: 145 - protein, 455 aa, Aspergillus nomius
  misc_feature (450)..(455): Xaa can be any naturally occurring amino acid
MSISAVDSRIFRNLFGTEEVREIFTDEAYAKFLVQTEAALARAESKVNAIPAEVGDAITAALGNIELDFERLSRETEIVGYPVLPLVMQLVENTPEELAKYIHWGATTQDVMDNASMLQIKRGLDLVKRDLNRLIESLQVMAQKYRDTPMAGRTHLQHALPCTFGYKCAVYLSSILRHRDRLCEIERRCLLVQFGGAAGTLASLGSDRSGILVRAQLAKELDLEDPMITWHVARDNIAEVLNFLALVGGTLGKIALDIIVMSSNELDEVAEPFVPHRGASSTMPQKRNPISSEIILATSKLLRANASLGLDAMVVDFERASGPWHLEWVAIPESFTYAVGALHQTTFALSGLCVKEDSMEKNLHSTRGLIVGEAVMMGLAPFVGRQRAHDVVYEACKSAIEHDRVLLDVLKENKEVSEHLNETKLAQLCDPLNYLGSGQLMVDDVLRRVXXXXXX

SEQ ID NO: 146 - protein, 459 aa, Aspergillus flavus
  misc_feature (450)..(459): Xaa can be any naturally occurring amino acid
MSISALDSRIFRNLFGTEEVREIFTDEAYAKFLVQTEAALARAESKVNAIPADVGDAITAVLGNIELDFDRLSRETEIVGYPVLPLVMQLVENTPEDLAKYIHWGATTQDVMDNASMLQIKRGLDLVKRDLNKLIDILQVMAEKYRDTPMAGRTHLQHALPCTFGYKCAVYLSSILGHRDRLCQIERRCLLVQFGGAAGTLASLGSDRTGILVRAQLAKELELEDPMITWHVARDNIAEVLNFLALIGGTLGKIALDIIVMSSNELDEVAEPFVPHRGASSTMPQKRNPISSEIILATSKLLRANASLGLDAMVVDFERASGPWHLEWVAIPESFTYVVGALHQTTFALSGLCVKEDSMEKNLHSTRGLIVGEAVMMGLAPFVGRQRAHDVVYEACKSAIEHDRVLLDVLKENTEVSYHLNEAKLTQLCDPLNYLGSGQLMVDDVLKRVXXXXXXXXXX

SEQ ID NO: 147 - protein, 476 aa, Aspergillus nidulans
  misc_feature (3)..(29): Xaa can be any naturally occurring amino acid
MAXXXXXXXXXXXXXXXXXXXXXXXXXXXVSAIDSSIFRTLFGTEEIRKVFDDESYIARCVEAEAALARAQSKCNVIPSHIGSLVTDKALSSSLDMDRLRKETEIVGYPILPLVRQLSAMCGEDAGKYVHWGATTQDIMDLASVLQMKQGLGIVEKLLDDVIAVLRGLSVKYRDAPMAGRTHLQHALPVTFGYKCAVWLSGFQRHAQRLKQLRERTLFVQFGGAAGSLASLGSGDDGLRVRKALADELGLTNPPITWHVARDGVAEITNFLALLGGSLGKLALDVIIMSSNELGEVSEPFVPHRGASSTMPQKRNPISSEVILAASKRLRSNASLVLDGMVADFERASGPWHLEWVAIPESFVLAVGALEQTKFALGGLVVHEQAMLKNLHSTKGLIVAEAVMMGLAPFVGRQRAHDIVYEACQGTIESGGSLEEELLKNQEVLEKMGKDRISELCDPVNYLGSCGRMVDDVLAVD

SEQ ID NO: 148 - protein, 459 aa, Aspergillus oryzae
  misc_feature (450)..(459): Xaa can be any naturally occurring amino acid
MSISALDSRIFRNLFGTEEVREIFTDEAYAKFLVQTEAALARAESKVNAIPADVGDAITSVLGNIELDFDRLSRETEIVGYPVLPLVMQLVENTPEDLAKYIHWGATTQDVMDNASMLQIKRGLDLVKRDLNKLIDILQVMAEKYRDTPMAGRTHLQHALPCTFGYKCAVYLSSILRHRDRLRQIERRCLLVQFGGAAGTLASLGSDRTGILVRAQLAKELELEDPMITWHVARDNIAEVLNFLALIGGTLGKIALDIIVMSSNELDEVAEPFVPHRGASSTMPQKRNPISSEIILATSKLLRANASLGLDAMVVDFERASGPWHLEWVAIPESFTYAVGALYQTTFALSGLCVKEESMEKNLHSTRGLIVGEAVMMGLAPFVGRQRAHDVVYEACKSAIEHDRVLLDVLKENTEVSEHFNEAKLTQLCDPLSYLGSGQLMVDDVLKRVXXXXXXXXXX

SEQ ID NO: 149 - protein, 459 aa, Aspergillus flavus
  misc_feature (450)..(459): Xaa can be any naturally occurring amino acid
MSISALDSRIFRNLFGTEEVREIFTDEAYAKFLVQTEAALARAESKVNAIPADVGDAITAVLGNIELDFDRLSRETETVGYPVLPLVMQLVENTPEDLAKYIHWGATTQDVMDNASMLQIKRGLDLVKRDLNKLIDILQVMAEKYRDTPMAGRTHLQHALPCTFGYKCAVYLSSILRHRDRLCQIERRCLLVQFGGAAGTLASLGSDRTGILVRAQLAKELELEDPMITWHVARDNIAEVLNFLALIGGTLGKIALDIIVMSSNELDEVAEPFVPHRGASSTMPQKRNPISSEIILATSKLLRANASLGLDAMVVDFERASGPWHLEWVAIPESFTYAVGALYQTTFALSGLCVKEESMEKNLHSTRGLIVGEAVMMGLAPFVGRQRAHDVVYEACKSAIEHDRVLLDVLKENTEVSEHFNEAKLTQLCDPLSYLGSGQLMVDDVLKRVXXXXXXXXXX

SEQ ID NO: 150 - protein, 475 aa, Aspergillus terreus
  misc_feature (3)..(28): Xaa can be any naturally occurring amino acid
MSXXXXXXXXXXXXXXXXXXXXXXXXXXVSAIDSSIFRTLFGTEEIRKVFDDEAYINRCIDAEAALARAQSRCNVIPPQVGEMVTQKAIHSKLDLDRLRRETEIVGYPILPLVRQLSAMCGEEAGRYVHWGATTQDIMDLASVLQMKEGLVIVERLLRDIIATLRELSAKYRDTPMAGRTHLQHALPVTFGYKCAVWLSGFQRHLERLEQLRSRTLLVQFGGAAGSLASLGDGDDGLRVRRALAEELGLADPPITWHVARDGVAEIANFLALMGGSMGKLALDIIVMSSNELGEVSEPFVPHRGASSTMPQKRNPISSEVILAASKVLRSNAGLVLDGMVADFERASGPWHLEWVAVPESFVIAVGALSQTHFALSGLCVHSKQMLDNLHSTKGLIVAEAVMMGLAPHVGRNKAHDIVYEACRESIEKDRTLLECLLEKPEVTSKMSTEEVSKLCDPVNYLGASGRMVDDVLAVD

SEQ ID NO: 151 - protein, 449 aa, Aspergillus niger
MLNSAVDSRIFRNLFGTEEIRDIFADEAYIKCLVEVEIALARAEAKVNVIPHESANVIAENAKYENLDLDRMAADTENVGYPVLPLVWQLAEMVPEEHAKYIHWGATTQDIMDCASMVQMRRGLAIVRRNLHELDATLKSLSEKYADTPMAGRTHLQHALPITFGYKCAVYLSGIQRHIQRLTEIERRCLLVQFGGAAGTLASLGSDDTGLKVRKQLATELGLHDPSITWHVARDHIAEIINFLALIGGSLGKIALDIIIMSSNEVAEVAEPFVPFRGASSTMPQKRNPISSEAILASSKLLRSNASLALDAMVSDFERASGPWHLEWSCVPDSFVLCCGALHQANFIMKGLLVNTEAMSDNLNMTKGLIVAEAVMMGTAPKLGRQRAHDVVYEACTKAIEGNLPLIDVLQQDNSLVAEVGVERLRSLCDPCQYLGCCRQMIENVIRDE

SEQ ID NO: 152 - protein, 449 aa, Aspergillus niger; identical to SEQ ID NO: 15

SEQ ID NO: 153 - protein, 449 aa, Aspergillus kawachii
MLNSAVDSRIFRNLFGTEEIRDIFSDEAYIKCLVEVEIALARAEAKVNVIPHESANVIAENAKYENLDLDRMAADTENVGYPVLPLVWQLAEMVPGEHAKYIHWGATTQDIMDCASMVQMRRGLVIVRRNLHELNATLKSLSEKYADTPMAGRTHLQHALPITFGYKCAVYLSGLQRHIQRLTEIEHRCLLVQFGGAAGTLASLGSDDTGLEVRKQLATELGLHDPSITWHVARDHIAEIINFLALIGGSLGKIALDIIIMSSNEVAEVAEPFVPFRGASSTMPQKRNPISSEVILASSKLLRSNASLALDAMVSDFERASGPWHLEWSCVPDSFVLCCGALHQANFVIKGLLVNTEAMSNNLNMTKGLIVAEAVMMGTAPKLGRQRAHDVAYEACTKAIEGNLPLIDVLQQDNSLVAEVGVERLRSLCDPCQYLGCCRQMIENVIHDE

SEQ ID NO: 154 - protein, 477 aa, Aspergillus niger
  misc_feature (3)..(30): Xaa can be any naturally occurring amino acid
MSXXXXXXXXXXXXXXXXXXXXXXXXXXXXVSAIDSGIFRTLFGTEEIRKVFDDEAYIKRCMDAEAALARAQSRCDVIPSQIGEMVTRKLRESKLDMERLRYETEIVGYPILPLVRQLSAICGDEAGKYVHWGATTQDIMDLASVLQMKEGLDIVEHHLKKVISTLRGLSVKYKDTPMAGRTHLQHALPVTFGYKCAVWLSGFQRQLERLEQLKERCLLVQFGGAAGSLASLGTGDDGLRVRKALAEELGLTDPPITWHVARDGIAEITNFLALMGGSMGKLALDIIIMSSNELGEVSEPFVPHRGASSTMPQKRNPISSEVILAASKILRSNAGLVLDGMVADFERASGPWHLEWVAIPESFVIAVGALSQTQFALSGLCVHGQKMLENLHSTKGLIVAEAVMMGLAPHVGRQQAHDIVYEACRESIEANQSLLECLMKKTEVTSKMSEERLSQLCDPVNYLGASTRMVEDVLAVD

SEQ ID NO: 155 - protein, 459 aa, Aspergillus ruber
  misc_feature (450)..(459): Xaa can be any naturally occurring amino acid
MSISAFDSRIFRNLFGTEEIRSIFTDEAYTQYLVQTEAALARAESTIGAIPQDAGAAITAALDTVRLDFERLSQETEVVGYPVLPLVMQLVEHTPEAMGKYIHWGATTQDIMDVASILQMKEGLKLVERELDTLIGILTSLSGKHRDTPMAGRTHLQHALPCTFGYKCAVYLSSILRHKDRLQQLRERCLLVQFGGAAGTLASLGTDDIGLRVRAQLAKELGLENPMITWHVARDNIGEILGYLALVGGTLGKIALDLIIMSSNEMDEVSEPFVPHRGASSTMPQKRNPISSEVILAASKLLRSHASLGLDAMVVDFERASGPWHLEWAAIPEAFTVAVGALYQTKFALGGLVVKEASMMKNLLCTRGLIVGEAVMMNLGEYIGRQQAHDVVYNACNAAIEEDRALLDVLKEDSCVVEQLGEDKLAQLCDPLNYLGSCQLMVDRVVNEAXXXXXXXXXX

SEQ ID NO: 156 - protein, 477 aa, Aspergillus niger
  misc_feature (3)..(30): Xaa can be any naturally occurring amino acid
MSXXXXXXXXXXXXXXXXXXXXXXXXXXXXVSAIDSGIFRTLFGTEEIRKVFDDEAYIKRCMDAEAALARAQSRCDVIPSQIGEMVTRKLRESKLDMERLRYETEIVGYPILPLVRQLSAICGDEAGKYVHWGATTQDIMDLASVLQMKEGLDIVEHHLKKVISTLRGLSVKYKDTPMAGRTHLQHALPVTFGYKCAVWLSGFQRHLERLEQLKDRCLLVQFGGAAGSMASLGTGDDGLRVRKALAEELGLTDPPITWHVARDGIAEITNFLALMGGSMGKLALDIIIMSSNELGEVSEPFVPHRGASSTMPQKRNPISSEVILAASKILRSNAGLVLDGMVADFERASGPWHLEWVAIPESFVIAVGALSQTQFALSGLCVHSQKMLENLHSTKGLIVAEAVMMGLAPHVGRQQAHDTVYEACRESIEANQSLLECLMKKTEVTSKMSEERLSQLYDPVNYLGASTRMVEDVLAVD

SEQ ID NO: 157 - protein, 474 aa, Aspergillus calidoustus
  misc_feature (3)..(27): Xaa can be any naturally occurring amino acid
MSXXXXXXXXXXXXXXXXXXXXXXXXXVSAIDSSIFRTLFGTEEIRKVFNDESYISRCIDAEAALARAQSTCGVIPSHIGSLVTTKVTSTPLDMERLRTETEIVGYPILPLVRQLSAMCGSEAGKYVHWGATTQDIMDLASILQMKRGLEIVERLVGEIIGVLRGLSVRYRDTPMAGRTHLQHALPVTFGYKCAVWLSGFQRHAARLKEMRERVLMVQFGGAAGSLASLGDGDDGIRVRKALAEELGLSDPPITWHVARDGVAEVTNYLALLGGSMGKLALDIIIMSSNELGEVSEPFVPHRGASSTMPQKRNPISSEVILAASKVLRSNAGLVLDGMVADFERASGPWHLEWVAVPESFVIAVGALEQTKFALGGLCVHSEAMLRNLHSTKGLIVAEAVMMGLAPAVGRQRAHDIVYEACRESIESGGSLEEALLGKTEVTEKMSVERVRQLCDPVNYLGASGRMVDDVLAVD

SEQ ID NO: 158 - protein, 450 aa, Aspergillus calidoustus
  misc_feature (450)..(450): Xaa can be any naturally occurring amino acid
MVVSALDSRVFRNLFGTAEVREIFTDDAYVGFLVEVEAALARAEAAVGVIPADAGTAITDAFKSISLDFDLLARETDIVGYPVLPLVKQLVNGTPGEMSKYIHWGATTQDIMDDASVLQMKRGLQLVRRELQTLAGTLQGLAQKYRDTPMAGRTHLQHALPCTFGYKCAVYLSSILRHQERLEEIERRCLLVQFGGAAGTLASLQDPDTGLKVRAELAKELGLRDPLITWHVARDTIAEILNFLALIGGTLGKIALDLIVMSSNEFDEVSEPFVPHRGASSTMPQKRNPISSEVILAASKLLRSNASLGLDAMVTDFERASGPWHLEWVAIPEAFITAVGALHQTNFALGGLVVKVDSMSRNLHSTRGLIVGEAVMMGLAPVLGRQKAHDVVYEACKTAIEGNRSLLEVLQENSELSKTLPADQLASLCDPLQYLGASQRMVDAVVGALX

SEQ ID NO: 159 - protein, 444 aa, Artificial Sequence
  CAK41914.1  unnamed
MLNSAVDSRIFRNLFGTEEIRDIFSDEAYIKCLIEVEIALARAEATFNVIPQESADVIAEKAKYENLNLSRMAADTENVGYPVLPLVWQLAEMVPQEHAKYIHWGATTQDIMDCASMVQIRRGLVVVRRNLHELDTALRALSEKYADTPMAGRTHLQHALPITFGYKCAVYLSGIQRHIQRLAEIELRCLLVQFGGAAGTLASLGSDNTGLQVRKQLARELGLHDPSITWHVARDHVAEVVNFLALVGGSLGKIALDIIIMSSNEVAEVAEPFVPFRGASSTMPQKRNPISSEVILASSKLLRSNASLALDAMVSDFERASGPWHLEWSCIPDSFVLCCGALHQANFIMRGLLVNTDVMSSNLNMTKGLIVAEAVMMGTAPKIGRQRAHDVVYEACTKAIEGNLPLIDILRQDESLVAQVGEEKLRSLCDPWVRSGVKDVTDYG

SEQ ID NO: 160 - protein, 443 aa, Ustilago maydis; identical to SEQ ID NO: 17

SEQ ID NO: 161 - protein, 395 aa, Aspergillus niger; identical to SEQ ID NO: 18

SEQ ID NO: 162 - protein, 389 aa, Aspergillus niger
MLRQLRHTLPSGSRSLSTKKQHHLPAAYYRGGTSRAIFFKQDDLPADKAKWDPIFRGVLGSPDPYGRQLDGLGGGISSLSKICVVGKPTHPSADIDYTFVSLGVKTPDVDYSSNCGNMISAVGPFAVDSGLVVPGLTSASVRIHNTNTGKIVHSSFPVVDGEAAASGEFAIDGVSGTAAPVQLDFVDPAGSRTGKLLPTGQVRDVFDGVEATCIDVANPCVFVRAEDLEVEGNLTPEEITAHPGLLDRLDSIRRQAGVKMGLADTREAVPGSVPKICLVSQPGTDTRAVEQKQTKEKVDLLVRALSVGQPHKAVPITVALAVASAARMSGSTVSQVVGEKRVDEAGITLGHASGNLLVGATFDEEGILRFATVFRTARRLFEGRIFWKG

SEQ ID NO: 163 - protein, 377 aa, Aspergillus flavus
MKKQRSLPAAYYRGGTSRAVFFRQEDLPRDRKSWDPIFLDVIGSPDPYGRQLDGLGGGISSLSKICIVGKSQHPEADVDYTFVSLGVKTPDVDYSSNCGNMISAVGPFAVDSKLVQVSSNATDASIRIHNTNTGKVIRATFPVVDGEAASSGTFAIDGVASTAARIKLDFLNPAGSRTGKLLPTGNVVDTFDGVAATCIDVANPCTFVRASDLGVEGNLTPDEIEVHPDLLARLDSIRRQAGVKMGLASTPETIPGSVPKICLVSTPPENERAVQQKQTASDVDVLARSISVGQPHKAVPITVALALASAARVQGSIVADVASKQPVDQAGITIGHTSGNLLVGADFDPNGALSAATVFRTARRLFEGRIFWKDESM

SEQ ID NO: 164 - protein, 377 aa, Aspergillus oryzae
MKKQRSLPAAYYRGGTSRAVFFRQEDLPRDRKSWDPIFLDVIGSPDPYGRQLDGLGGGISSLSKICIVGKSQHPEADVDYTFVSLGVKTPDVDYSSNCGNMISAVGPFAVDSKLVQVSSNATDASIRIHNTNTGKVIRATFPVVDGEAASSGTFAIDGVASTAARIKLDFLNPAGSRTGKLLPTGNVVDTFDGVAATCIDVANPCTFVRASDLGVDGNLTPDEIEVHPDLLARLDSIRRQAGVKMGLASTPETIPGSVPKICLVSTPPENERAVQQKQTASDVDVLARSISVGQPHKAVPITVALALASAARVQGSTVADVASKQPVDQAGITIGHTSGNLLVGADFDPNGALSAATVFRTARRLFEGRIFWKDESM

SEQ ID NO: 165 - protein, 395 aa, Aspergillus niger
MPIQRIMLRPLRHTLPSGSRSLSTKKQHHLPAAYYRGGTSRAIFFKQDDLPADKAKWDPIFRGVIGSPDPYGRQLDGLGGGISSLSKICVVGKPTHPGADIDYTFVSLGVKTPDVDYSSNCGNMISAVGPFAVDSGLVLPGLTSASVRIHNTNTGKIVHSSFPVVDGEAAASGEFAIDGVSGTAAPVQLDFVDPAGSRTGKLLPTGQVRDVFDGVEATCIDVANPCVFVRAEDLEVEGNLTPEEITVHPGLLDRLDSIRRQAGVKMGLADTRETVPGSVPKICLVSQPGTDTRAVEQKQTKEKVDLLVRALSVGQPHKAVPITVALAVASAARVSGSTVSQVVGEKRVDETGITLGHASGNLLVGATFDDEGTLRFATVFRTARRLFEGRIFWKG

SEQ ID NO: 166 - protein, 411 aa, Aspergillus ruber
MFRPILRASPRGIFSTPRQLRTLTTKKQHSLPAAYYRGGTSRAVFFKQSDLPHDRAQWDHIFRSVIGSPDPYGRQLDGMGGGISSLSKVCVVGKSTHPNADVDYTFIALGVYTPEVDYSSNCGNMISAVGPYAVDAGLFSTTGGSNSVAVRIHNTNTGKVIHSSFPIVDGEAATSGDFSIDGVAGTAARVQLDFVDPAGSRTGKLLPTGQVRDTFDGVVATCIDVANPCVFVRAAELGAPGNMTPDEITVHTNLLPRLDSIRRQAGVKMGLAETLEKVPGSVPKICLVSSPANDARAKEQNQTVEKVDLVARALSVGQPHKAVPITVALALASAARLPGSTVNEVASTNRVDDAGVTIGHASGNLLVGATFDENGGLNAATVFRTARRVFEGRIFWKNEPRALSDKDGNCK

SEQ ID NO: 167 - protein, 387 aa, Aspergillus calidoustus
MFTRTIQQSKLTLQFLRHASSRASQNSLPAAYYRGGTSRAVFFNQADLPRNRTEWAPIFRGVIGSPDPYGRQLDGLGGGISSLSKVCVVGAATHPAADVDYTFAALGVKNDEVDFSSNCGNMVSAVGPYAVDAGLFDVHGEAESAVVRIHNTNTGKIIHATFPLAEGEAAARGELAVDGVAGTAAPIKLDFIDPAGSRTGKMLPTGVVRDVFDGVEATCVDVANPCVFVRAEDLGVEGTLSPDEITAAPGLLERLDSIRRQAGVAMGLAGTLEEVPGSVPKIGMVSSPKEASDGRGVDLVVRALSVGQPHKAVPITVALALVTAARLPGSTVAEVTSSDPVDPSRITIGHASGNILVGATFGADGGLEFATVFRTARRLFEGRIFWK

SEQ ID NO: 168 - protein, 1717 aa, Aspergillus parasiticus
MKKQRSLPAAYYRGGTSRAVFFRQDDLPRDRKSWDPIFLDVIGSPDPYGRQLDGLGGGISSLSKICIVGKSQHPEADVDYTFVSLGVKTPDVDYSSNCGNMISAVGPFAVDSKLVQVSSDTTDVSVRIHNTNTGKVIRATFPVVNGEAASSGTFAIDGVASTAARIKLDFLNPAGSRTGKLLPTGNVVDTFDGVAATCIDVANPCTFVQASDLGVDGNLTPDEIEMHPDLLARLDSIRRQAGVKMGLASTPETIPGSVPKICLVSTPPENGRAVQQKQTASDVDVLARSISVGQPHKAIPITVALALASAARVQGSTVADVASKQPVDQAGITIGHASGNLLVGADFDPNGALSAATVFRTARRLFEGRTECGEGAQHRKYAQLSGDSKGENMNSRRFNPWQLRLPAQFLGGIVVDSLGVLPPVSAVDGENKNVMVKRQHAGRDADFRCQSLREQLASLERRYEALAQQHEELLAQKDKDRLHDGANPRALDGLALANSSSHYHDTMGTSESVVPQSRDLQRNANCSYSGRILRPTFSKSTNIEGMNMSTLSCAWNLWGDDSVPTEQPISSSLLNDAAYVELVNIFFERRWPYLPVLHRPTFEAKYLTPFMTNLEVDPVSNFFVYMVLAIAATEKSWVEQENRFIHREFFGRAVQELHYIMRIDDFECAQCLLLLCMYGHNEPQAVNLWYTSGLALRLATGIDLHRRESLVGLDLFRTEMSKRVFWCAYVMDCSIAVNMGRPLGIQDTDISTPLPLQLSDDQLRDAVEPPDPESVTIPKVTDTSTFIHIIKLRRMNAEIYKAFHPAVRSSSARDEIDALRSYYYSELNMWLVTAPRYPHTHSTFQSLEWFHIAFNHAIMSLYRPSRTAPILSADDLRICTEAAIGLISSYSSLYARNKIKYTFVAIHSLFLAALTMLYALRASPALRQDLTKPVISTNISTFLTLFRGISNGRAVGEKCSSIIERLGTAILTLFDDTEQPISAVDDEFQSWFGLQTNIFSPRDRDAIFGDPVGMSSHLPDVRVDLPWTDLFIEGLDMGALLGIRAYMPSYLNFLESENQRLKEQSASSANATEADHDAEPEPVPAADAPDESNTSVRNPLIGDRAWFHRYDPSAPPLFVGEAACTAFATRFRRFLTGNNALPHIPRTQYVKEEQIAEANATNVQWPSFQQARLLVKIALRQVGSIYHLVLRKSTLEKLEEIYRTGDFDCTVNQCKFFALFAFGEAYSMRAEPLSGSRVPGTSYFARALSLGQVLPERTSITHLETLLLLVSVLSLQTVNQLRNQSLFSYYLNRRHSALVLIGTALRLGLSIGLNHNIPESQLIDPVERQHRIRIWWTIYIFDRMWGSKMGHPSQIPDDDIHLDMPSNISPAKLHEEQFTDTEYLTANVKLARIVGETIAKLYSRRKYSETFLQRVQKLLKALKNWVETLPEHLRLNDDDPGTYMKHISSLHLSFNQCVILTTRPTLLHLLMKLNETNSPNPNHESISQPVLTLGEACIHAARHSHSLILTKWINGSLPVFGYFHAHYLFSSALVLAMSSFLPIGSPSDLGAFESGLEVLRSMSENGNLAASEFYHNLEQVKQCLDLRKSKEPKSNSTTGQPNTTASGSGPTIPPSTLHPTASAVTPATTVPVPSLLTTAEADLISNNPGYGPAQSSNTTIPPGNFTFPTTAGGITTAMAFLEPTMQDFLAQSDFDLGLLHPVDTFMNDENLYTCHGL

SEQ ID NO: 169 - protein, 383 aa, Aspergillus udagawae
MSGTALLSKKQNSIPAAYYRGGTSRAIFFREEDLPSEQQQWDDIFRGTIGSPDPYGRQLDGMGGGISSLSKVCVVGKSDRPDADVDYTFVSLGVKNTDVDYSSNCGNMISAVGPYAVDTGLFPVADDANAVSVRIFNTNTGKVIRSTFPVVDGEAAAAGDFSIDGVAGTAAQIRLDFIDPAGSRTGKLLPTGEVVDCFDDIPASCVDVGNPCVFVRASDLGVRGNLAPDEIDAHPTLLPQLDSIRRQAGVKMGLAETPKEVPGSVPKICLVSSPSDSCTSGMMQTSKDVDLVVRALSVGQPHKAVPITVALALATAARVSGTVVANVVSDQPVDPAGITLGHASGNLLVSADFDAEGHLSCATVYRTARRIMEGRVFWKDTSA

SEQ ID NO: 170 - protein, 389 aa, Aspergillus lentulus
MHRHFTSSIASLSKKQNSIPAAYYRGGTSRAIFFRKEDLPLERQQWDDIFRGTIGSPDPYGRQLDGMGGGISSLSKVCVVSKSDRPDADVEYTFVSLGVKNMDVDYSSNCGNMISAVGPYAVDAGLFSVAGDANDVVSVRIFNTNTGKVIRSTFPVVDGEAAAAGDFAIDGVAGTGARIQLDFIDPAGSRTGKLLPTGKVVDCLDGIPASCIDVGNPCVFVRASDLGVPGNLTPDEIDAHPTLLSQLDSIRRQAGVKMGLAETPKEVPGSVPKICLVSSPSDSYTSGMMQTSKDVDLVVRALSVGQPHKAVPITVALALATAARVSGTVVADVVSDKPVDSAGITLGHASGNLLVSADFDPSGRLGCATVYRTARRIMEGRVFWRDTSA

SEQ ID NO: 171 - protein, 505 aa, Aspergillus fumigatus
MAQAKPPRLLPAFYSIVLLCSADERMSSPLESHWGDLVDESHQDPIDATQWTANLHSSSPKGISDPEDESFRIRTPADSVIGPIADSATALRHVRLFVDFMDIETIPLWKRAAGTTQRKIAFADLTAPFSKKQNSIPAAYYRGGTSRAIFFRKEDLPSEQQQWDDIFRGTIGSPDPYGRQLDGMGGGISSLSKVCVVSKSDRPDADVEYTFVSLGVKNMDVDYSSNCGNMISAVGPYAVDTGLFPVADDADVVSVRIFNTNTGKIIRSTFPVVDGEAAAAGGFAIDGVASTGARIRLDFIDPAGSRTGKLLPTGKSVDCFDDIPASCVDVGNPCVFVRASDLGVPGNLAPDKIDAHPTLLSQLDSIRRQAGVKMGLAGTTKEVPGSVPKICLVSSPSDAYTSGMMQTPKDVDLVVRALSVGQPHKAVPITVALALATAARVSGTVVADVVSDKPVDPAGITLGHASGKLLVGADFDPTGHVSCATVYRTARRIMEGRVFWKGVST

SEQ ID NO: 172 - protein, 380 aa, Aspergillus fumigatus
MATSSLSTTQPESAYYRGGTSRAIFFRKEDLPSEQQQWDDIFRGTIGSPDPYGRQLDGMGGGISSLSKVCVVSKSDRPDADVEYTFVSLGVKNMDVDYSSNCGNMISAVGPYAVDTGLFPVADDADVVSVRIFNTNTGKIIRSTFPVVDGEAAAAGGFAIDGVAGTGARIRLDFIDPAGSRTGKLLPTGKSVDCFDDIPASCVDVGNPCVFVRASDLGVPGNLAPDKIDAHPTLLSQLDSIRRQAGVKMGLAGTTKEVPGSVPKICLVSSPSDAYTSGMMQTPKDVDLVVRALSVGQPHKAVPITVALALATAARVSGTVVADVVSDKPVDPAGITLGHASGKLLVGADFDPTGHVSCATVYRTARRIMEGRVFWKGVST

SEQ ID NO: 173 - protein, 410 aa, Aspergillus fumigatus
MMVSRPLRWLLHPSPLRSQNVRVHRQFISSTAPLSKKQNSIPAAYYRGGTSRAIFFRKEDLPSEQQQWDDIFRGTIGSPDPYGRQLDGMGGGISSLSKVCVVSKSDRPDADVEYTFVSLGVKNMDVDYSSNCGNMISAVGPYAVDTGLFPVADDADVVSVRIFNTNTGKIIRSTFPVVDGEAAAAGGFAIDGVAGTGARIRLDFIDPAGSRTGKLLPTGKSVDCFDDIPASCVDVGNPCVFVRASDLGVPGNLAPDKIDAHPTLLSQLDSIRRQAGVKMGLAGTTKEVPGSVPKICLVSSPSDAYTSGMMQTPKDVDLVVRALSVGQPHKAVPITVALALATAARVSGTVVADVVSDKPVDPAGITLGHASGKLLVGADFDPTGHVSCATVYRTARRIMEGRVFWKGVST

SEQ ID NO: 174 - protein, 409 aa, Aspergillus fumigatus
MVSRPLRRLLHPSPLRSQNVRVHRQFISSTAPLSKKQNSIPAAYYRGGTSRAVFFRKEDLPSEQQQWDDIFRGTIGSPDPYGRQLDGMGGGISSLSKVCVVSKSDRPDADVEYTFVSLGVKNMDVDYSSNCGNMISAVGPYAVDTGLFPVADDADVVSVRIFNTNTGKIIRSTFPVVDGEAAAAGGFAIDGVAGTGARIRLDFIDPAGSRTGKLLPTGKSVDCFDDIPASCVDVGNPCVFVRASDLGVPGNLAPDKIDAHPTLLSQLDSIRRQAGVKMGLAGTTKEVPGSVPKICLVSSPSDAYTSGMMQTPKDVDLVVRALSVGQPHKAVPITVALALATAARVSGTVVADVVSDKPVDPAGITLGHASGKLLVGADFDPTGHVSCATVYRTARRIMEGRVFWKGVST

SEQ ID NO: 175 - protein, 381 aa, Aspergillus niger; identical to SEQ ID NO: 19

SEQ ID NO: 176 - protein, 381 aa, Aspergillus kawachii
MFKYTYRNQVAFSARRYLSKQHSLPAAYYRGGTSRAVMFNQAHLPPRSEWDAIFRSVIGSPDPYGRQLDGLGGGISSLSKVCVVGKSTHPDADVDYTFVSLGVKNSDVDYSSNCGNMISAIGPFALDQKLVSSQTPESATVRIHNTNTGKIITASFPVVDGEAASSGDFAIDGVAGTAARIRLDFVNPAGSVTGKMLPTGQTRDKFDGVSATCIDVANPCVFVPASSLGVRGDLTPDEIAAHPDLLQRLDSIRRQAGVKMGIAPTTDAVPGSIPKVCMVSPPQESKGKDSVDLLVRAISVGQPHKAVPITVALAVSAAARVGGSTVEDATNKDRVSDSGLTIGHASGNLLVGAKFEEDQLTAATVFRTARRLFEGQIYWKS

SEQ ID NO: 177 - protein, 409 aa, Aspergillus fischeri
MVSRPLRRLLHPSKLRNQNVKVHRQFISSTAPLSKKQNSIPAAYYRGGTSRAIFFRKEDLPSEQQQWDDIFRGTIGSPDPYGRQLDGMGGGISSLSKVCVVSKSDRPNADVEYTFVSLGVKNMDVDYSSNCGNMISAVGPYAVDTGLFPVADDANVVSVRIFNTNTGKVIRSTFPVVDGEAAAAGDFAIDGVAGTGARIRLDFIDPAGSRTGKLLPTGKGIDCFDDIPASCIDVGNPCVFVRASDLRVPGNLAPDEIDAHPTLFSQLDSIRRQAGVKMGLAETPTEVPGSVPKICLVSSPSDSYTSGMMQTSKDVDLVVRALSVGQPHKAVPITVALALATAARVSGTVVADVVSDKPVDPAGITLGHASGNLLVGADFDPSGRLSCATVYRTARRIMEGRVFWKDVSA

SEQ ID NO: 178 - protein, 381 aa, Aspergillus niger
MFKYTYRNRVASSARRYLSKQHSIPAAYYRGGTSRAVMFNQAHLPPRSEWDAIFRSVIGSPDPYGRQLDGLGGGISSLSKVCVVGKSTHPDADVDYTFVSLGVKNSDVDYSSNCGNMISAIGPFALDQKLVSSQTPESATVRIHNTNTGKIITASFPVVDGEAASSGNFAIDGVAGTAARIQLDFVNPAGSVTGKMLPTGQTRDEFDGVPATCIDVANPCVFVPASSLGVRGDLTPDEIAAHPDLLQRLDSIRRQAGVKMGIASTTGAVPGSIPKVCMVSPPQPSKEKDPVDLLVRAISVGQPHKAVPITVALAVSAAARVTGSTVEDATNQDRVSDAGLTIGHASGNLLVGAQFENDQLTAATVFRTARRLFEGRIYWKS

SEQ ID NO: 179 - protein, 381 aa, Aspergillus niger
MFKYTYRNRAAFSARRYLSKQHSLPAAYYRGGTSRAVMFNQAHLPPRSEWDAIFRSVIGSPDPYGRQLDGLGGGISSLSKVCVVGKSTHPDADVDYTFVSLGVKNSDVDYSSNCGNMISAIGPFALDQKLVSSQTPESATVRIHNTNTGKIITASFPVVDGEAASSGDFAIDGVAGTAARIQLDFVNPAGSVTGKMLPTGQTRDEFDGVPATCIDVANPCVFVSASSLGVRGDLTPDEIAAHPDLLQRLDSIRRQAGVKMGIAPTTDAVPGSIPKVCMVSPPQESKGKDSVDLLVRAISVGQPHKAVPITVALAVSAAARVVGSTVEDATNKDRVSDAGLTIGHASGNLLVGAKFEEDQLTAATVFRTARRLFEGQIYWKS

SEQ ID NO: 180 - protein, 405 aa, Aspergillus clavatus
MAITPLQQAMRSSAATNLQTHRRFSSGAWLYVKKQHSLPAAYYRGGTSRAIFFRREDLPRDQTQWDGIFRGSIGSPDPYGRQLDGMGGGISSLSKICVVNKSARLDADVDYTFVSLGVKNCDVDYSSNCGNMVSAVGPYAVDTGLYPVAAKGNDSVSVRIFNTNTGKIIRSTFPVVDGEAATSGDFAIDGVSGTAARVRLDFIDPAGSRTGQLLPTGNVVDIVDETPTTCIDVGNPCVFVHSSDLGVAGNLTPSEIDSHPTLLTRLDSIRRQAGVRMGLAASPEEVPGSVPKICLVSTPSRSSLSDLKQSIYDVDLVVRALSVGQPHKAVPITVALALAAAARVVGSVVASVMSNQPVDSGGITLGHASGNLLVSADIDPAGHLSCATVFRTARRIMEGRVFWRD

SEQ ID NO: 181 - protein, 400 aa, Aspergillus nomius
MLLRRTPFRPLIQSLLSSRAHLSTHTKPQKSLPAAYYRGGTSRAVIFKTEDLPTDRSAWDEIFRRVIGSPDPNGRQLDGLGGGISSLSKICIVGKSTTPDVDIDYTFVSLGVKNTHVDYSSNCGNMISAIGPFAVDSGLFPVSPDGHEDVELRILNTNTGKVIRSRFPVVEGEAAASGEFAIDGVAGTAAKIQLDFLDPAGSKTGKLFPTGKVVDEFDGVRTTCIDVSNPCCFVLASELGVEGNITPEEIDADPTLLGRLDSIRRQAGVAMGLAETAESVPGSVPKIGLVASPAMNARASEQGQTQADVDLLVRALSVGQPHKAVPITVALALAAAAQVSGSVVAGVTSGKAVDPAGITLGHASGKLVVGAEFGSDGSLSHATVFRTARRLMEGRVFWKS

SEQ ID NO: 182 - protein, 386 aa, Aspergillus nidulans
MLARAIQRCQRPRLSLYRQLSSFRISQSSLPAAYYRGGTSRAVFFNQDDLPKSRDEWAPIFRGVIGSPDPYGRQLDGLGGGISSLSKVCVVGKSAHPDADVDYTFAALGIRDTDVDFSSNCGNMVSAVGPYAVDSGLFAAHKDAESAVVRIHNTNTGKIIHATFPIINGEAAAAGELAIDGVAGTAAPIKLDFVNPAGSRTGKLLPTEAVKDVFDGVEATCIDVANPCVFVKADDLGVSGALTPDEITATPGLLARLDSIRRQAGAKMGLARSPEAVPGSVPKIGIVSIPKDDSRVDLVVRALSVGQPHKAVPITVALALATAARLPGSTVADVTSSDPVDPTGITIGHASGSILVGATFGADGGLDFATVFRTARRLFEGRIFWK

SEQ ID NO: 183 - protein, 395 aa, Aspergillus terreus
MISRRLPGMINTTSRGAAFSSLAHRRAPQRSLPASYYRGGTSRAVFFKQSDLPTDHTSWDEIFRRVIGSPDPNGRQLDGLGGGISSLSKICVVGPSTRPDADIDYTFVAMGVKDSQVDYSSNCGNMISAVGPFAVDSQLVPVQPDGHAEADLRIHNTNTGKIIRSRFPVEDGEAASSGSFAIDGVAGTAAKIQLDFLDPAGSRTGSLLPTGQVVDTFDGVSTTCIDVGNPCCFVLASDLGVKGTITPDEIDAHPTLLPRLDSIRRQAGVAMGLADHPDGVPGSVPKIGMVSAPPSNTQASGPAVDVVVRALSVGQPHRAVPITVALALAAAAKVPGSVVASMTKVPPVDETGITLGHASGTLMVGAEFGPDGQLSHATVFRTARRLMEGRVFWKA

SEQ ID NO: 184 - protein, 400 aa, Aspergillus oryzae
MLPRRTSFRPLTQTLLPNRANLSTRTKPQKSLPAAYYRGGTSRAVIFKKEDLPTDRSAWDEIFRRVIGSPDPNGRQLDGLGGGISSLSKICVVSKSTTPDVDIDYTFVSLGVKNTHVDYSSNCGNMISAIGPFAVDSRLFPVNSDGYEDVELRILNTNTGKVIRSRFPVVEGEAAASGDFAIDGVAGTAAKIQLDFLDPAGSKTGKLFPTGKVVDEFDGVRTTCIDVSNPCCFVLASELGVEGNITPEEIEAHPTLLDRLDSIRRQAGVAMGLAETAESVPGSVPKIGLVASPASNARALEQGQTEADVDLLVRALSVGQPHKAVPITVALALAAAARVPGSVVAGVTSGELVDPAGITLGHASGKLVVGAEFGVDGSLSHATVFRTARRLMEGKVFWKS

SEQ ID NO: 185 - protein, 400 aa, Aspergillus flavus
MLPRRTSFRPLTQTLLPNRANLSTRTKPQKSLPAAYYRGGTSRAVIFKKEDLPTDRSAWDEIFRRVIGSPDPNGRQLDGLGGGISSLSKICVVGKSTTPDVDIDYTFVSLGVKNTHVDYSSNCGNMISAIGPFAVDSRLFPVNSDGYEDVELRILNTNTGKVIRSRFPVVEGEAAASGDFAIDGVAGTAAKIQLDFLDPAGSKTGKLFPTGKVVDEFDGVRTTCIDVSNPCCFVLASELGVEGNITPEEIDAHPTLLDRLDSIRRQAGVAMGLAETAESVPGSVPKIGLVASPASNARALEQGQTEADVDLLVRALSVGQPHKAVPITVALALAAAARVPGSVVAGVTSGELVDPAGITLGHASGKLVVGAEFGVDGSLSHATVFRTARRLMEGKVFWKS

SEQ ID NO: 186 - protein, 400 aa, Aspergillus flavus
MLPRRSSFRPLTQTLLPNRANLSTRTKPQKSLPAAYYRGGTSRAVIFKKEDLPTDRSAWDEIFRHVIGSPDPNGRQLDGLGGGISSLSKICVVGKSTTPDVDIDYTFVSLGVKNTHVDYSSNCGNMISAIGPFAVDSRLFPVNSDGYEDVELRILNTNTGKVIRSRFPVVEGEAAASGDFAIDGVAGTAAKIQLDFLDPAGSKTGKLFPTGKVVDEFDGVRTTCIDVSNPCCFVLASELGVEGNITPEEIDAHPTLLDRLDSIRRQAGVAMGLAETAESVPGSVPKIGLVASPASNARALEQGQTEADVDLLVRALSVGQPHKAVPITVALALAAAARVPGSVVAGVTSGELVDPAGITLGHASGKLVVGAEFGVDGSLSHATVFRTARRLMEGKVFWKS

SEQ ID NO: 187 - protein, 400 aa, Aspergillus oryzae
MLPRRTSFRPLTQTLLPNRANLSTRTKPQKSLPAAYYRGGTSRAVIFKKEDLPTDRSAWDEIFRRVIGSPDPNGRQLDGLGGGISSLSKICVVGKSTTPDVDIDYTFVSLGVKNTHVDYSSNCGNMISAIGPFAVDSRLFPVNSDGYEDVELRILNTNTGKVIRSRFPVVEGEAAASGDFAIDGVAGTAAKIQLDFLDPAGSKTGKLFPTGKVVDEFDGVRTTCIDVSNPCCFVLASELGVEGNITPEEIEAHPTLLDRLDSIRRQAGVAMGLAETAESVPGSVPKIGLVASPASNARALEQGQTEADVDLLVRALSVGQPHKAVPITVALALAAAARVPGSVVAGVTSGELVDPAGITLGHASGKLVVGAEFGVDGSLSHATVFRTARRLMEGKVFWKS

SEQ ID NO: 188 - protein, 400 aa, Aspergillus parasiticus
MLLRRTTFRPLTQNFLPNRANLSIRTKPQKSLPAAYYRGGTSRAVIFKKEDLPTDRSAWDEIFRRVIGSPDPNGRQLDGLGGGISSLSKICVVGKSTTPDVDIDYTFVSLGVKNTHVDYSSNCGNMISAIGPFAVDSRLFPVNSDGYEDVELRILNTNTGKVIRSRFPVVEGEAAASGDFAIDGVAGTAAKIQLDFLDPAGSKTGKLFPTGKVVNEFDGVRTTCIDVSNPCCFVLASELGVEGNITPEEIDAHPTLLDRLDSIRRQAGVAMGLAETTESVPGSVPKIGLVASPASNARATEQGQTEADVDLLVRALSVGQPHKAVPITVALALAAAARVPGSVVAGVTSGELVDPAGITLGHASGKLVVGAEFGADGSLSHGTVFRTARRLMEGRVFWKS

SEQ ID NO: 189 - protein, 451 aa, Aspergillus calidoustus
MVPLVSRLIQTRLSSTQAFKKASESFLPYVPAFKPRNRVDPIWPSPSIMIDEPVSLQPRPRRHVLPCVLMRAGTSKGIFLHRRDLPLDKLDWAPHLISALGSRGNDPRQIDGVGGGTSTTSKVAVVSRSERPDADIDWTFVQVAVGKESIDLTGNCGNMTAGVAPFAVQEGLVRPQPGQTKMDVRIYNTNTRRIVVETVALDASGDYDETGDYTIAGVSTPGSEVKCTFVEPIGSMTGKLFPSDGQQQQLLHAHSTDQQPPFTVRVTLIDSANPFVLIDSTSIQTLFKNLSSEVAQNSLIESIRREAAVAMGLAPTVEAAAQTRGTPKAALVYPPDSDTADVRIQAYSMGLPHPSLQLTGAVTVAVALSYPDTVVAELAAMAGNRMTPEHTPPPDEGSEKRDSAVEREVRIAHSKGVIKVGVVMARNGGVASCAVSRTARRLFEGRIRYYV

SEQ ID NO: 190 - protein, 424 aa, Aspergillus flavus
MATELVTETRRLRRHALPCVLMRAGTSKGIFLHQKDLPTKEADWAPHLISALGSRGNDPRQIDGVGGGTSTTSKVAVVRRSQRPDADVDWTFVQVAVGKESVDFTGTCGNMTAGVAPFAIQEGLVKPRRDQTKMDVRIYNTNTDRIVIETVALDDSGDYEEDGNFIISGVKSPGSEVKCRFVKPMGSMTGKLFPSDNQQQQTLHVQPGSLMPNLEPFDVRVTLIDSANPFVLIDTTSISTTLLGTNPSDSDRNDLVETIRRAGAVAMGLATDVEAASRTRGTPKVALMYPPTFTQANGSKKSRPDIRVQAYSMGLPHPSLQLTGAVTIAVALSYPGTIAAGLSAMGAIMHGALPPTPEQSPPPDDREKENFGWERDVLIEHSQGTIKVGVVMDDVGEVASCAVSRTARRLFEGKVRYYIQEDAM

SEQ ID NO: 191 - protein, 424 aa, Aspergillus oryzae
MATELVTETRRLRRHALPCVLMRAGTSKGIFLHQKDLPTKEADWAPHLISALGSRGNDPRQIDGVGGGTSTTSKVAVVRRSQRPDADVDWTFVQVAVGKESVDFTGTCGNMTAGVAPFAIQEGLVKPRRDQTKMDVRIYNTNTDRIVIETVALDDSGDYEEDGNFIISGVKSPGSEVKCRFVKPMGSMTGKLFPSDNQQQQTLHVQPGSLMPNLEPFDVRVTLIDSANPFVLIDTTSISTTLLGTNPSDSDRNDLVETIRRAGAVAMGLATDVEAASRTRGTPKVALMYPPTFTQANGSKKSRPDIRVQAYSMGLPHPSLQLTGAVTIAVALSYPGTIAAGLSAMGAIMHGALPPTPEQSPPPDDREKENIGWERDVLIEHSQGTIKVGVVMDDVGEVASCAVSRTARRLFEGKVRYYIQEDAM

SEQ ID NO: 192 - protein, 424 aa, Aspergillus oryzae
MATELVTETRRLRRHALPCVLMRAGTSKGIFLHQKDLPTKEADWAPHLISALGSQGNDPRQIDGVGGGTSTTSKVAVVRRSQRPDADVDWTFVQVAVGKESVDFTGTCGNMTAGVAPFAIQEGLVKPRRDQTKMDVRIYNTNTDRIVIETVALDDSGDYEEDGNFIISGVKSPGSEVKCRFVKPMGSMTGKLFPSDNQQQQTLHVQPGSLMPNLEPFDVRVTLIDSANPFVLIDTTSISTTLLGTNPSDSDRNDLVETIRRAGAVAMGLATDVEAASRTRGTPKVALMYPPTFTQANGSKKSRPDIRVQAYSMGLPHPSLQLTGAVTIAVALSYPGTIAAGLSAMGAIMHGALPPTPEQSPPPDDREKENIGWERDVLIEHSQGTIKVGVVMDDVGEVASCAVSRTARRLFEGKVRYYIQEDAM

SEQ ID NO: 193 - protein, 406 aa, Aspergillus niger
MPKSSQYSLPATYYRGGTSKALFFREDVLPDPGPQRDRLLKRAMGSPEPLQLDGMGGSKAVTSKIAIVRPSTRSDADIDFTFAQVGVARDFIHYGANCGNISAAVGPFAIEEGLVQFRPGRSVRIYNTGTGKLLSAHFPVSGSGAFEPEGTHEIAGDPGKGSPVLLDYRFTIGAELSRGLLPTGNASDMITVAGKEFEITICDIANLCVFANARDFNITGHETAADLTANLDWLAKTQELLGKAAVLAGIRIPDSVVNRVIGDAVELDTLEISHPVGTMAVFVQTEMPMKDEPVFETSRLFEPPAASWLELYTYPVASGQMHLRNDQFPMFYHWVMGRFHLQVTCIWTASFAIDVTRRPVQGHIWIWHHDGFLHVLFVQTLGDMGGKSALTLSHSNVLCAQGWYML

SEQ ID NO: 194 - protein, 425 aa, Aspergillus niger
MTQTYSVTRAEPFTVLPITTKYRSNESVRKSLPAVWMRAGTSKGLFLHRRHLPASKTLWEPILLSAMGSSKGSSRQIDGVGGASSTTSKVAIVERSNRPGVDVEYTFVQVAPDQPRIDVTGNCGNIASGVGPFALDEGLWDDVWETRLIEPQVNIKILNTNTGQHIFETVQVATDGSFREDGDYAIPGVEGTASPIRVAFLKPCGSMTGQMFPSGMHQEMLTVQSRGFGTLAVRVSLVDAANPFVFVDAASLPVEASSSIADAADPVFLGLIEDIRRHGAVRFGLAENVQAAGQVRGTPKIAILSPATGDVDGVDIEVKAFSMGKPHASLQLTGAVCLGAATIIHGTIAWDLAHAKEGKEMPKHGMSLGDHQIAGAVPVGIRHPAGVIHTETVLGMDRHGAIDVDRVAVYRTARRLFEGRVFYRP

SEQ ID NO: 195 - protein, 1229 aa, Aspergillus flavus
MESVHGNKSVSASETSFRPRRRRALEACSFCRRRKIKCNNERPVCINCKTYAQDCIYEPIGGRGRETGGGHHDRSRHRRSIQRGALNVDKDEDSQSSLLPQNDGRIDHLPEVDEVTTSSNRFNGDTERRGAPGCSEARVARILVSANGESSYHGRTSALFEDHAQDRSIGADQRPGMPDDWVERGLVAEAAKQRQMEQLNFRQGKLDFDGVDPDLGMHLLSLHWNRQHHSFLITYRPAFMRDMACNGPYFSKLLLNAIYFGAAKFSPRLEVRKDPNDVRTAGWRYRERVRELLGGALDRSDITTIQALLVMTNSLFALGDERSAAWLYSGLAFRMLIDLGMHVDLTSTRRFSDEDLEIRRRVFWGAFVVDKIQSLYQGRPVSLKETDALVPIKFLDTYEELEHWQPFAYSTSAPDYPGMPAYSISTFTCLCKLSLTMSDILSCIYTERSSNQSPAELASMLDELQLRLDQWQAGLPEHLRFDPGKAHSVAFPPPHVSSLHAMHNSLVILLHRPFVADGHLYSTSPSISVDSFKKCASAASNISNLLRAYHRAFSIRRAPYLISYATYVAATVLTRIAARRKNDSTAHANLATCLAVFKENQETNSAVKKAANIVQGLMKKLGVIIDNVSIDALEIDPPIRCSERNPQHSHSAIEGDASVQANASNQPQNSLGIGSVTGLSNTKALSQPISSPGSDWVDIDGIIQSFLQENSSRGARLVEYETNGTPTQLPRAPWVPLHQGDLPPTMMMDNARTVGNQASLRPDIDVPNGRDGTAIENGTIYSPTIRHGYDPMAKTPIAVHPNLFVMATELVTETRRLRRHALPCVLMRAGTSKGIFLHQKDLPTKEADWAPHLISALGSRGNDPRQIDGVGGGTSTTSKVAVVRRSQRPDADVDWTFVQVAVGKESVDFTGTCGNMTAGVAPFAIQEGLVKPRRDQTKMDVRIYNTNTDRIVIETVALDDSGDYEEDGNFIISGVKSPGSEVKCRFVKPMGSMTGKLFPSDNQQQQTLHVQPGSLMPNLEPFDVRVTLIDSANPFVLIDTTSISTTLLGTNPSDSDRNDLVETIRRAGAVAMGLATDVEAASRTRGTPKVALMYPPTFTQANGSKKSRPDIRVQAYSMGLPHPSLQLTGAVTIAVALSYPGTIAAGLSAMGAIMHGALPPTPEQSPPPDDREKENFGWERDVLIEHSQGTIKVGVVMDDVGEVASCAVSRTARRLFEGKVRYYIQEDAM

SEQ ID NO: 196 - protein, 406 aa, Aspergillus niger; identical to SEQ ID NO: 193

SEQ ID NO: 197 - protein, 1271 aa, Aspergillus nomius
MESTHSKPSVPPSEPSLRSRRRRAIEACSFCRRRKIKCNNERPVCINCKTYAQDCVYEPIGSKAREAGDTRHNRPRHRRSLEKSALNDGKDGRSHPGRLPQGDGRVDQLQEMHEGTASSNRSNGDIDRGDATGSSEARVAHILVSANGESSYHGRTSALFEDHFQDRSIGADQRPRMPDDWVERGLVAEAAKQRQMEQLNFRQAKLDFDGVDPDLGMHLLSLHWNRQHHSFLITYRPAFMRDMACNGPYFSKLLLNAIYFGAAKFSPRLEVRKDPNDVRTAGWRYRERVRELLGGALDHSDITTIQALLVMTNSLFALGDERSAAWLYSGLAFRMLIDMGMHVDLTSTHRFSDEDLEIRRRVFWGAFVVDKIQSLYQGRPVSLKDTDALVPIKFLDTYEELEHWQPFAYTTSAPDYPGMPAYSISTFTCLCKLSLIMSDILSSIYTERSSNQSPAELASMLDELQLRLDQWKARLPEHLRFDPGKARSVAFPPPHVSSLHAMHNSLVILLHRPFVADGHLYSTSPSISVDSFMKCASAASNTSNLLRAYHRAFSIRRAPYLISYATYVAATILTRIAAKRRHDSIAHANLATCLAVFKENQETNSAVKKAANIVQGLMKRLGVVIDNISLDALEIDPPVKSSERDPQPNDRATDGDVSVQPSAGTETHNSLTSGNVTGYSNTKSPGQPIQSPGSDWVDIDGIIQSFLHENSTRGARLLDYEANGTPTQLSRAPWMPLHQCDIPATVTMDNARHVGSQASLRPDIDVTNGAHRSETASGTSQWQYGWRPTNCEPTSLEDPLFGLNVSAASSQQSTRQTQEYSKWLPGDILAVLYPKTLMLPVLARPNLPDMATELVTKTRRLKRHALPCVLMRAGTSKGIFLHQKDLPMKEVDWAPHLVSALGSRGNDPRQIDGVGGGTSTTSKVAVVRRSQRPDADIDWTFVQVAVGKESVDFTGTCGNMTAGVAPFAIQEGLIKPQREQTKMDVRIYNTNTDRIVIETVTLNSSGDYEEDGNFIISGVKTPGSEVKCRFVKPFGSMTGKLFPSADQQQQTLWVQPLMPGREPFDVRVTLIDSANPFVLIDTTSISATLLGTNPSDSDRNDLVESIRRAGAVAMGLATDVEAAGRTRGTPKAALVFPPTITQAGGSIKARPDIRIQAYSMGLPHPSLQLTGAVTIAVALSYPGTIVAGLSAMGSIMHGTLPPTPAQSPPPDYQKEEHCGSGRDVLIEHSQGTIKVDVEMDNGGEVASCSVSRTARRLFEGKVRYYIQEDEL

SEQ ID NO: 198 - protein, 404 aa, Aspergillus niger
MTQTYSVTRAEPIPVLPITTKYRSNESVRKSLPAVWMRAGTSKGLFLHRRHLPASKTLWEPILLSAMGSSKGSSRQIDGVGGASSTTSKVAIVERSNRPGVDVEYTFVQVAPDQPRIDVTGNCGNIASGVGPFALDEGLVNIPEGEKEVNIKILNTNTGQHIFETVQVATDGSFREDGDYAIPGVEGTASPIRVAFLKPCGSMTGQMFPSGMHQEMLTVQSRGFGTLAVRVSLVDAANPFVFVDAASLPVEASSSIADAADPVFLGLIEDIRRHGAVRFGLAENVQAAGQVRGTPKIAILSPATGDVDGVDIEVKAFSMGKPHASLQLTGAVCLGAATIIHGTIAWDLAHAKEGKEMPKHGMSLGDHQIAGATVLGMDRHGAIDVDRVAVYRTARRLFEGRVFY

SEQ ID NO: 199 - protein, 416 aa, Aspergillus udagawae
MSPAYAISPVEYSPVKALKYAPPSSRKTLPAVWMRSGTSKGLFLHRHHLPASTHLWEPILLSAMGSSQGDGRQIDGVGGASSTTSKVAVVERSSRPNVDVEYTFVQVAPDQPRIDMTGNCGNIAAGVGPFALDEGIVRAAPGQKEIDIRTYNTNTRQLIVETVQIAPDGTFQEEGEYRIPGVAGTSSPIRLAFLRPGGSMTGRLFPSGAQQEMLTVQSRAMGTFTVRVSLVDAANPFVLVDAASLPIPDQDRRPDDPVFLSVIEDIRREGAVQFGLAADVEAAGTVRGTPKIALLSSATAEDDEADLRVLAFTMGKAHASLQLTGAVCVGAATVIHGTIAWELAQKGKRDTRPKHGMSVGNHQIAPPLSVGIRHPAGVIHVEAVLGMDHTGEVSVDNVAVFRTARRLFEGNVYYRV

SEQ ID NO: 200 - protein, 425 aa, Aspergillus niger; identical to SEQ ID NO: 194

SEQ ID NO: 201 - protein, 404 aa, Aspergillus ruber
MTQTYSISRAESIPILQILKYTPEVPVRKSLPAVWMRAGTSKGLFFHRHHLPASAAHWEPILLSAMGSTKESSRQIDGVGGASSTTSKVAVVERSSRPGVDVEYTFVQVAPDQPRVDLTGNCGNIASGVGPFALDEGLVCAPDGKKEIDIRIYNTNTGQALVETVQVAADGSFQEGGKYAIPGVEGTASPVRIAFLNPGGSMTGRMFPSGLRQETLTVQSRGFGPFAVRVSLVDAANPFVLIDVASLPVDSRLADSADPELLALIEDIRRHGAVRFGLAADVQAAGLVRSTPKVALLSRARGDADGVDIEVRAFTMGKPHASLQLTGAVCLGAATVIHGTIAWDLAHAKEGGDNLSKHGMSIGGYQIAGATILGMDWKGDIDVDRVAVFRTARRLFEGSVFYRA

SEQ ID NO: 202 - protein, 355 aa, Aspergillus kawachii
MGSSTGSSRQIDGVGGASSTTSKVAIVERSSRPGVDVEYTFVQVAPDQPRIDMTGNCGNIASGVGPFALDEGLVSVPEREKEINIRIYNTNTGQHIVETVQVANDGSFREDGDYAIPGVEGTASPIKVAFLKPCGSMTGHMFPSGRHQEMLTVQSRGFGTLSVRVSLVDAANPFVFVDAASLPREASSTIADAADPAFLALIEDIRQHGAVRFGLAENVQAASQVRGTPKIAILSPASGTVDGVDIEVKAFSMGKPHPSLQLTGAVCLGAATIIHGTIAWDLAHIKEGKEIPKHGMSLGNHQIAGAVPVGIRHSAGVVHAETVLGIDRKGAIDVDRVAVYRTARRLFEGRVFYRP

SEQ ID NO: 203 - protein, 277 aa, Aspergillus nomius
MISAVGPFAVDSKLVQVSSAASEASVRIHNTNTGKVIRATFPVVDGEAASSGTFAIDGVASTAARVQLDFLNPSGSRTGKLLPTGNVVDTFDGVAATCIDVANPCTFVRASDLGVDGNLTPEEVEAHPDLLVRLDSIRRQAGVKMGLASTPETVPGSVPKICLVSTPPENRRAIQQKQTVRDVDVLARSISVGQPHKAIPITVALALASAARVQGSTVADVASKQPVDQAGITIGHASGNLLVGADFDPTGALSAATVFRTARRLFEGRIFWKDESI

SEQ ID NO: 204 - protein, 355 aa, Aspergillus niger
MGSSTGRSRQIDGVGGASSTTSKVAIVERSSRPGVDVEYTFVQVAPDQPRIDMTGNCGNIASGVGPFALDEGLVSVPERKKEIDIKIYNTNTGQHIIETVQVATDGSFREDGEYAIPGVGGTASPIKVAFLRPCGSMTGHMFPSGKHQEMLTVQSRGFGTLSVRVSLVDAANPFVFVDAASLPREASSAITDAADPAFLALIEDIRQHGAVRFGLAENVQAASQVRGTPKIAILSPASGNVDGVDIEVKAFSMGKPHPSLQLTGAVCLGAATIIHGTIAWDLAHVKVGKEIPKHGMSLGDHQIAGAVPVGIRHSAGVIHAETVLGIDRKGAIDVDRVAVYRTARRLFEGRVFYRP

SEQ ID NO: 205 - protein, 407 aa, Aspergillus nomius
MPGISKHVVSHASNSARTGIPEVWMRAGTSKGLFIHEHDLPSSKDLWAPILLSALGLAEADKRQLNGVGGATSTTSKVAVVRKSKRHGVDVDYTFVQVASDQAQVDMTGNCGNMASGVGPFALDEELTSECLTPTHSKSWSKPSTSPPDGNFCEDGDYSIAGVRGTASPIQMTFIKPGGSITGRLFPSGAKQEMLTVSSAHTPTPFIVRVSLVDAANPFVLVDSSTMPAAYLDSEATSRLSLAIIEDIRVAGAVRFGLARATAAAGRVRGTPKIALLYPGGREVDTEGRINEADIEVLPFSLGQPHPSLQLTGAVCLGTALSIPETVAWDLRRQEAAHVHHNVPSEQQVIMFEPRMSTVKRLLKHPNGLMDVEARLETHENGETSVESVSVFRTARRLFEGKVFYRL

SEQ ID NO: 206 - protein, 231 aa, Aspergillus terreus
MSQTYSITQTESIPVVQTIQWTQKASVRKSIPAVWMRAGTSKGLFIHRHHLPPSPADWEPILLSAMGSTKEGSRQINGVGGASSTTSKVAVVERSSRPGVDVEYTFVQVAPDQPRIDMTGNCGNIASGIGPFALDEGLVRAPEGKKEIDIRIYNTNTKQHLVETVQVAVDGSFREDGEYAIPGVDGMASPVRVAFLNPGGSMTGCMFPSGLRQETLAVTSRGHGAFDASWR

SEQ ID NO: 207 - protein, 404 aa, Aspergillus flavus
MPGISKHAVSHTSNPVRTGIPAVWMRAGTSKGLFIHEHDLPWSKDLWAPILLSALGSAEGGKRQLNGVGGATPTTSKVAVIRKSKLPVVDADYTFVQVAPDQAQVDMTGNCGNMASGVGPFALDEELFHVLAPLLNWQMDITVFNTNTQQILVETVHVTPDGRFSEDGDYSIAGVRGTASPIRMNIIKPAGSMTGRLFPSGAKQEMLTVGSAHTPTPFIVRVSLVDAANPFALLSASTMPAAYHGSEPTSPLSLGIIEEIRVAGAVRFGLAEDTATAGRVIGTPKIALLYPCRREVDVGRHIDETDIEVLPFSLGQPHPSLQLTGAVCVGTALSIPGTVAWDIQRQAPGVHHGDSQTRQAMMINPTMSTVKWLLEHPSGLMGVEVTWGCTRTGRHPWRVSVVGI

SEQ ID NO: 208 - protein, 399 aa, Aspergillus oryzae
MPGISKHAVSHASNPVRTGIPAVWMRAGTSKGLFIHEHDLPWVKDLWAPILLSALGSAEGGKRQLNGVGGATPTTSKVAVIRKSKIPVVDADYTFVQVAPDQAQVDMTGNCGNMASGVGPFALDEELFHVLAPLLNWQMDITVFNTNTQQILVETVHVTPDGRFSEDGDYSIAGVRGTASPIRMNIIKPAGSMTGRLFPSGAKQEMLTVGSAHTPTPFIVRVSLVDAANPFALLSASTMPAAYHGSEPTSPLSLGIIEEIRVAGAVRFGLAEDTATAGRVIGTPKIALLYPCRREVDVGRHIDEADIEVLPFSLGQPHPSLQLTGAVCVGTALSIPGTVAWDIQRQAPGVHHGDSQTREVVAQTPQWTDGRGGDVGMHENGETSVESVSMFRTARRLFE

SEQ ID NO: 209 - protein, 436 aa, Aspergillus flavus
MPGISKHAVSHASNPVRTGIPAVWMRAGTSKGLFIHEHDLPWSKDLWAPILLSALGSAEGGKRQLNGVGGATPTTSKVAVIRKSKIPVVDADYTFVQVAPDQAQVDMTGNCGNMASGVGPFALDEELVRPTIQGQRTFHVLAPLLNWQMHITVFNTNTQQILVETVHVTPDGRFSEDGDYSIAGVRGTASPIRMNIIKPAGSMTGRLFPSGAKQEMLTVGSAHTPTPFIVRVSLVDAANPFALLSASTMPAAYHGSEPTSPLSLGIIEEIRVAGAVRFGLAEDTATAGRVIGTPKIAHLYPCRREVDVGRHIDEADIEVLPFSLGQPHPSLQPTGAVCVGTALSIPGTVAWDIQRQAPGVHHGDSQTRQAMMINLTMSTVKWLLKHPSGLMGVEVAWGCTRTGRHPWRVSVCSAPHDDCLSKRCFIACNHRSWVFR

SEQ ID NO: 210 - protein, 333 aa, Aspergillus parasiticus
MRAGTSKGLFIHEHYLRSSKDLWAPILLSTLGSAEADKRQLNGVGGTTSTTSKVAVIRKSKKPGVDVDYTFVQVALDQAQVDTTGNCGNMASGVGPFALDEELQILVEAVHVTPDGKFSEDGDYSIAGSRHSESVRVSLVDAANPFVWVDASTMPAAYHNSEPTSALSLGIIEAIRVAGAVRFGLAQDTATAGRIMSTPKIALLYPCRHEIDVGRRIDETDIEVLPFSLGQPHPSLQLTGAVCVGTALSIPGTVAWDVQPQAPSVHHGASQERQAMMINPTMSTVSLLLKHPSGLMDMEVKLEMHEDRETAVESVSVFRTARRLFEGKVFYRL

The invention claimed is:

1. A method to increase production of itaconic acid in a micro-organism, comprising:
   (i) culturing a micro-organism selected from the group of strains as deposited under no. CBS 141661 and CBS 141662 with the Westerdijk Fungal Biodiversity Institute in a suitable medium;
   (ii) inhibiting expression or function of itaconyl-CoA transferase (EC 2.8.3.-), itaconyl-CoA hydratase (citramalyl-CoA hydro-lyase; EC 4.2.1.56), citramalyl CoA lyase (EC 4.1.3.25), or a combination thereof in the micro-organism;
   and providing the micro-organism with a gene encoding for the enzyme 2-methylcitrate dehydratase, wherein the production of itaconic acid is increased at least 2 fold compared to a parental micro-organism.

2. The method according to claim 1, wherein the inhibition is caused by mutation of the gene encoding for said itaconyl-CoA transferase (EC 2.8.3.-), itaconyl-CoA hydratase (citramalyl-CoA hydro-lyase; EC 4.2.1.56), citramalyl CoA lyase (EC 4.1.3.25), or a combination thereof.

3. The method according to claim 2, wherein the mutation is chosen from:
   a. mutation of a promoter or insertion of an inducible promoter;
   b. mutation of the coding sequence, chosen from insertion, deletion or change of one or more nucleotides;
   c. insertion of a protein binding site; and
   d. combinations thereof.

4. The method according to claim 3, wherein said mutation created by CRISPR-Cas9 technology.

5. The method according to claim 1, wherein the expression of said enzyme or enzymes is silenced.

6. The method according to claim 5, wherein said silencing is created by:
   a. CRISPRi technology
   b. antisense silencing;
   c. sense co-suppression; or
   d. RNA interference.

7. The method according to claim 1, wherein said micro-organism is a micro-organism which naturally produces itaconic acid, wherein said micro-organism is further provided with a gene encoding for the enzyme aconitase.

8. The method according to claim 1, wherein said micro-organism is genetically constructed to produce itaconic acid by introducing a gene encoding for the enzyme cis-aconitic acid decarboxylase.

9. The method according to claim 1, wherein said micro-organism is an *Aspergillus*.

10. The method according to claim 8, wherein the gene encoding for the enzyme cis-aconitic acid decarboxylase is ATEG_09971.1 (EAU29420.1).

11. The method according to claim 8, wherein said micro-organism is further provided with a gene encoding for a tricarboxylic acid transporter, a gene for an itaconic acid transporter, a gene encoding the enzyme aconitase, a gene encoding for the enzyme 2-methylcitrate dehydratase, or a combination thereof.

12. The method according to claim 11, wherein said gene encoding for a tricarboxylic acid transporter is ATEG_09970.1 (EAU29419.1) and said gene encoding for an itaconic acid transporter is ATEG_09972.1 (EAU29421.1).

13. The method according to claim 9, wherein said *Aspergillus* is *A. terreus* or *A. niger*.

14. A method for producing itaconic acid in a micro-organism, comprising culturing a micro-organism selected from the group of strains as deposited under no. CBS 141661 and CBS 141662 with the Westerdijk Fungal Biodiversity Institute in a suitable medium, wherein the production of itaconic acid is increased at least 2 fold compared to a parental micro-organism, thereby producing itaconic acid and optionally isolating said itaconic acid from the medium.

15. The method according to claim 14, further comprising inhibiting the expression or function of itaconyl-CoA transferase (EC 2.8.3.-), itaconyl-CoA hydratase (citramalyl-CoA hydro-lyase; EC 4.2.1.56), citramalyl CoA lyase (EC 4.1.3.25), or a combination thereof, and wherein said micro-organism is further provided with a gene encoding for the enzyme 2-methylcitrate dehydratase.

* * * * *